United States Patent 11,299,751 (COMPOSITIONS FOR THE TREATMENT OF DISEASE) - sequence listing, part 2

SEQ ID NO: 3481 - protein, 120 aa, Artificial Sequence
  Description of Artificial Sequence: Synthetic polypeptide
QVTLKESGPTLVNPTQTLTLTCTFSGFSLSTGGVGVGWFRQPPGKALEWLARIDWDDDKYYSTSLKTRLTISKDTSKIQVVLTMTNMDPVDTATYYCARMGFTGTYFDYWGQGTLVTVSS

SEQ ID NO: 3482 - protein, 119 aa, Artificial Sequence
  Description of Artificial Sequence: Synthetic polypeptide
QMQLVQSGGGVVQPGRSLRLSCAASGFTFSSYGMHWVRQAPGKGLEWVAVILYDGSNKYYADSVKGRFTISRDNSKNALYLQMNSLRAEDTAVYYCAKVTNPGDAFDIWGQGTMVTVSS

SEQ ID NO: 3483 - protein, 118 aa, Artificial Sequence
  Description of Artificial Sequence: Synthetic polypeptide
QVQLQELGGGVVQPGRSLRLSCAASGFTFGSYGMHWVRQAPGKGLEWVATISYDGSIKDYADSEKGRFTISRDNSKNTLYLQMNSLRAEDTAVYYCAKGGKTGEFDYWGQGTLVTVSS

SEQ ID NO: 3484 - protein, 118 aa, Artificial Sequence
  Description of Artificial Sequence: Synthetic polypeptide
EVQLVQSGGGVVQPGRSLRLSCAASGFTFSSYGMHWVRQAPGKGLEWVATISYDGSIKDYADSEEGRFTISRDNSKNTLYLQMNSLRAEDTAVYYCAKGGKTGEFDYWGQGTLVTVSS

SEQ ID NO: 3485 - protein, 119 aa, Artificial Sequence; identical to SEQ ID NO: 3467
  Description of Artificial Sequence: Synthetic polypeptide

SEQ ID NO: 3486 - protein, 223 aa, Artificial Sequence
  Description of Artificial Sequence: Synthetic polypeptide
LESGPGLVKPSETLSLTCTVSGGPVSSVNFYWSWIRQPPGKGLEWIGYIYYSGSTNYNPSLKSRITTSVDTSKNQFSLKLSAVTAADTAVYYCARERLTTGAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTS

SEQ ID NO: 3487 - protein, 223 aa, Artificial Sequence
  Description of Artificial Sequence: Synthetic polypeptide
LESGPGLVKPSETLSLTCTVSGGSISSVNSYWGWIRQPPGKGLEWIGNFYYSGNTHYNPSLKSRVTISVGTSKNQFSLKLNSVTAADTAVYYCARQSTIGGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTS

SEQ ID NO: 3488 - protein, 119 aa, Artificial Sequence
  Description of Artificial Sequence: Synthetic polypeptide
QVQLQESGGGVVQPGRSLRLSCAGSGFTLDDYAMHWVRQFPGKGLEWVSGINWNGSIKGYSDSVKGRFSVSRDNAKNVLYLQMTNLRPEDTALYYCAKETILATWGRGTLVTVSSASTK

SEQ ID NO: 3489 - protein, 119 aa, Artificial Sequence
  Description of Artificial Sequence: Synthetic polypeptide
QVQLQESGGGVVQPGRSLRLSCAGSGFTLDDYAMHWVRQFPGKCLEWVSGINWNGSIKGYSDSVKGRFSVSRDNAKNVLYLQMTNLRPEDTALYYCAKETILATWGRGTLVTVSSASTK

SEQ ID NO: 3490 - protein, 122 aa, Artificial Sequence
  Description of Artificial Sequence: Synthetic polypeptide
MAEVQLVESGPGLVKPSETLSLTCTVSGGSMRRSNYYWDWIRQPPGKGLEWIGSIYYSGTTYYNPSLKSRVTISVDTSKNQFSLKLSSVTAADTAVYYCASESTVTAKLDNWGQGTLVTVSS

SEQ ID NO: 3491 - protein, 122 aa, Artificial Sequence
  Description of Artificial Sequence: Synthetic polypeptide
MAEVQLVQSGPGLVKPSETLSLTCTVSGGSMRRSNYYWDWIRQPPGKGLEWIGSIYYSGTTYYNPSLKSRVTISVDTSKNQFSLKLSSVTAADTAVYYCASESTVTAKLDNWGQGTLVTVSS

SEQ ID NO: 3492 - protein, 122 aa, Artificial Sequence
  Description of Artificial Sequence: Synthetic polypeptide
MAQVQLVQSGPGLVKPSETLSLTCTVSGGSMRRSNYYWDWIRQPPGKGLEWIGSIYYSGTTYYNPSLKSRVTISVDTSKNQFSLKLSSVTAADTAVYYCASESTVTAKLDNWGQGTLVTVSS

SEQ ID NO: 3493 - protein, 125 aa, Artificial Sequence
  Description of Artificial Sequence: Synthetic polypeptide
QVQLLQSGAEVKKPGASVKVSCKASGYTFTSYYIHWLRQAPGQGLEWMGTINPGGGSTSYAEKFQDRVTMTRDTSASTAYMGLSSLRSEDTAVYYCARDLRGYISNWSTLGMDVWGQGTPVTVSS

SEQ ID NO: 3494 - protein, 474 aa, Artificial Sequence [sequence omitted]

SEQ ID NO: 3495 - protein, 234 aa, Artificial Sequence [sequence omitted]

SEQ ID NO: 3496 - protein, 232 aa, Artificial Sequence [sequence omitted]

SEQ ID NO: 3497 - protein, 476 aa, Artificial Sequence [sequence omitted]

SEQ ID NO: 3498 - protein, 213 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTDFTLTISSLQPEDFATYYCQQLNSYPPTFGGGTKVEIKTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3499 - protein, 218 aa, Artificial Sequence
  Description of Artificial Sequence: Synthetic polypeptide
QSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3500 - protein, 218 aa, Artificial Sequence
  Description of Artificial Sequence: Synthetic polypeptide
ESALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3501 - protein, 213 aa, Artificial Sequence
  Description of Artificial Sequence: Synthetic polypeptide
SYVLTQPPSVSVAPGKTARINCGGNNIEYRSVHWYQQKSGQAPVAVIYDNSDRPSGIPERFSGSKSGNTATLTISRVEAGDEADYYCQVWDISSDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3502 - protein, 214 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTDFTLTISSLQPEDFATYYCQQLNSYPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3503 - protein, 234 aa, Artificial Sequence [sequence omitted]

SEQ ID NO: 3504 - protein, 476 aa, Artificial Sequence [sequence omitted]

SEQ ID NO: 3505 - protein, 242 aa, Artificial Sequence [sequence omitted]

SEQ ID NO: 3506 - protein, 232 aa, Artificial Sequence [sequence omitted]

SEQ ID NO: 3507 - protein, 108 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVL

SEQ ID NO: 3508 - protein, 103 aa, Artificial Sequence
  Description of Artificial Sequence: Synthetic polypeptide
TQSPSSLSASVGDRVTITCRASQSISSYLNWYQQKPGKAPKLLIYAASSLQSGVPSRFSGSGSGTDFTLTISSLQPEDFATYYCQQSYSTPPTFGQGTKVEIK

SEQ ID NO: 3509 - protein, 109 aa, Artificial Sequence
  Description of Artificial Sequence: Synthetic polypeptide
QAVLTQPSSVSVAPGETASVTCGGDNIGSKSVHWYQKKPGQAPVLVVFDDSDRPSGIPERFSGSTSGNTAALTISRVEAGDEADYYCQVWDSSNDHLYVFGPGTQLTVL

SEQ ID NO: 3510 - protein, 107 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTDFTLTISSLQPEDFATYYCLQDYNYPRTFGQGTKVEIK

SEQ ID NO: 3511 - protein, 110 aa, Artificial Sequence
  Description of Artificial Sequence: Synthetic polypeptide
QPVLTQPLSASGTPGQRVTISCSGDTSNIGSNTVHWYQRLPGTAPKLLIHNNNQRPSGVPDRFSGAKSGTSASLAISGLQSEDEADYFCAAWDDNLNGYVFGTGTKVTVL

SEQ ID NO: 3512 - protein, 107 aa, Artificial Sequence
  Description of Artificial Sequence: Synthetic polypeptide
DIQMTQSPFSLSASVGDRVTITCRASQGIGSSLAWYQQKPGKAPKLLIYAASSLQSGVPSRFSGSGSGTDFTLTISSLQPEDFATYFCLQHHDYPLTFGGGTKLEIK

SEQ ID NO: 3513 - protein, 112 aa, Artificial Sequence
  Description of Artificial Sequence: Synthetic polypeptide
DVVMTQSPLSLPVTPGEPASISCRSSQSLLHSNGHDYLDWYVQKPGQSPQPLIYLGSDRASGVPDRFSGSGSGTHFTLNISRVEAEDVGVYYCMQSLQTPWTFGQGTKLEIK

SEQ ID NO: 3514 - protein, 107 aa, Artificial Sequence
  Description of Artificial Sequence: Synthetic polypeptide
DIQMTQSPSFVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 3515 - protein, 107 aa, Artificial Sequence
  Description of Artificial Sequence: Synthetic polypeptide
DIQLTQSPSSVSASVGDRVTITCRASQGISGWLAWYQQKPEKAPKLLIYAASSLQRGVPSRFSGSGSGTDFTLTISSLQPEDFATYYCQQANSFPPTFGQGTRLEIK

SEQ ID NO: 3516 - protein, 108 aa, Artificial Sequence
  Description of Artificial Sequence: Synthetic polypeptide
QPVLTQPPSVSVAPGQTARISCGGDNIGTNTVQWYQQKPGQAPVLVVYDDSDRPSGIPERFSGSNSGDTATLTISRVEAGDEADYYCQVWDDSSDLVVFGGGTKVTVL

SEQ ID NO: 3517 - protein, 107 aa, Artificial Sequence
  Description of Artificial Sequence: Synthetic polypeptide
DIQMTQSPSSLSASVGDRVTITCRASQGISTYLNWYQQKPGKAPNLLIYGASNLQSGVPSRFSGSESGTDFTLTISSLQPEDFATYYCQQSFTTPRTFGQGTKLEIK

SEQ ID NO: 3518 - protein, 107 aa, Artificial Sequence
  Description of Artificial Sequence: Synthetic polypeptide
DIQLTQSPSFLSASVGDRVTITCRASHSISSWLAWYQQKPGKAPKLLIYKASSLESGVPSRFSGSGSGTDFTLTISSLQPEDFATYYCLQDYNYPRTFGQGTKLEIK

SEQ ID NO: 3519 - protein, 107 aa, Artificial Sequence
  Description of Artificial Sequence: Synthetic polypeptide
DIQLTQSPSSLSASVGDRVTITCRASQGISSHLAWYQQKPGKAPKLLIYAASSLQSGVPSRFSGSGSGTEFTLTISSLQPEDFATYYCQQFNSYPITFGQGTRLEIK

SEQ ID NO: 3520 - protein, 107 aa, Artificial Sequence
  Description of Artificial Sequence: Synthetic polypeptide
DIQMTQSPSSLSASVGDRVTITCRASQGIRNDLGWYQQKPGKAPKLLIYAASSLQSGVPSRFSGSGSGTDFTLTISSLQPEDFATYYCQQLNSYPPTFGGGTKVEIK

SEQ ID NO: 3521 - protein, 107 aa, Artificial Sequence
  Description of Artificial Sequence: Synthetic polypeptide
DIQLTQSPSSVSASVGDRVTITCRASQGISSWLAWYQQKPGKAPRSLIYDASSLQSGVPSRFSGSGSGTDFTLTISSLQPEDFATYYCQQADSFPITFGQGTRLEIK

SEQ ID NO: 3522 - protein, 109 aa, Artificial Sequence
  Description of Artificial Sequence: Synthetic polypeptide
DIQLTQSPSTLSASVGDRVTITCRASQILGHWLPLSWYQQKPGKAPKLLISKASSLESGVPPRFSGSGSGSDFTLTISSLQPDDFATYYCLQYHEYPLTFGGGTKLEIK

SEQ ID NO: 3523 - protein, 107 aa, Artificial Sequence
  Description of Artificial Sequence: Synthetic polypeptide
DIQLTQSPSSLSASVGDRVTITCRASQGISSHLVWYQQKPGKAPKSLIYAASSLQSGVPSRFSGSESATDFTLTISSLQPEDFATYYCQQYYSYPITFGQGTRLEIK

SEQ ID NO: 3524 - protein, 107 aa, Artificial Sequence
  Description of Artificial Sequence: Synthetic polypeptide
DIQLTQSPSTLSASVGDRVTITCRASQGINSYLAWYQQEPGKAPKLLIYAASTLQSGVPSRFSGSGSGTEFTLTISSLQPEDFATYYCQQLNSYPFTFGPGTKVDIK

SEQ ID NO: 3525 - protein, 107 aa, Artificial Sequence
  Description of Artificial Sequence: Synthetic polypeptide
DIQMTQSPSSVSASVGDRVTITCRASQGISSYLAWYQQKPGKAPKLLIYDASSLESGVPSRFSGSGSGTEFTLTISSLQPDDFATYYCQQLNSYPLTFGGGTKVEIK

SEQ ID NO: 3526 - protein, 109 aa, Artificial Sequence
  Description of Artificial Sequence: Synthetic polypeptide
QSVLTQPPSVSVAPGKTARITCGGNNIGSKSVHWYQQKPGQAPVLVIYYDSDRPSGIPERFSGSNSGNTATLTISRVEAGDEADYYCQVWDSSSDHPYVFGTGTKLTVL

SEQ ID NO: 3527 - protein, 107 aa, Artificial Sequence
  Description of Artificial Sequence: Synthetic polypeptide
DIQMTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIK

SEQ ID NO: 3528 - protein, 107 aa, Artificial Sequence
  Description of Artificial Sequence: Synthetic polypeptide
DIQLTQSPSSLSASVGDRVTITCRASQGISSYLAWYQQKPGKGPKLLIYAASTLQSGVPSRFSGSGSGTDFSLTISSLQPEDLATYYCQQYDSYPLTFGGGTKVEIK

SEQ ID NO: 3529 - protein, 107 aa, Artificial Sequence
  Description of Artificial Sequence: Synthetic polypeptide
DVVMTQSPATLSVSPGESATLFCRASESVYSNLAWYQHKPGRAPRLLIYGASTRATGIPARFDGTGSGTDFTLTISSLQSEDFAVYYCQQYNDWPITFGQGTRLEIK

SEQ ID NO: 3530 - protein, 107 aa, Artificial Sequence
  Description of Artificial Sequence: Synthetic polypeptide
DIQLTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVDIK

SEQ ID NO: 3531 - protein, 214 aa, Artificial Sequence
  Description of Artificial Sequence: Synthetic polypeptide
ELQPPSVSAAPGQKVTISCSGSSSNIGSNYVSWYQQLPGAAPKLLIYDNNKRPSGIPDRFSGSKSGTSATLGITGLQTGDEADYYCGTWDSSLSAWVFGGGTKLTVLGQPKAAPSVTLFPPSSEELQANKATVVCLISDFYPGAVTVAWKADSSPVKAGVETTTPSKQSNSKYAASSYLSLTPEQWKSHRRYSCQVTHEGSTVEKTVAPTECSF

SEQ ID NO: 3532 - protein, 215 aa, Artificial Sequence
  Description of Artificial Sequence: Synthetic polypeptide
ELQPASVSGSLGQSITISCTGTSSDIGNYNLVSWYQQHPGKAPKLIIYEVTKRPSGVSNRFSGSKSGNTASLTISGLQAEDEANYYCSSYTATKNYWIFGGGTKLTVRGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSF

SEQ ID NO: 3533 - protein, 112 aa, Artificial Sequence
  Description of Artificial Sequence: Synthetic polypeptide
DIQMTQSPSTLSASVGDRVTITCRASHNINSWLAWYQQRPGKAPKLLIYKASSLESGVPSRFSGSGAGTDFNLTISSPQPDDFAAYYCQHYNTFSATFGQGTKVEIKRTVAA

SEQ ID NO: 3534 - protein, 112 aa, Artificial Sequence
  Description of Artificial Sequence: Synthetic polypeptide
DIQMTQSPSTLSASVGDRVTITCRASHNINSWLAWYQQRPGKAPKLLIYKASSLESGVPSRFSGSGAGTDFNLTISSPQPDDFAAYYCQHYNTFSATFGCGTKVEIKRTVAA

SEQ ID NO: 3535 - protein, 111 aa, Artificial Sequence
  Description of Artificial Sequence: Synthetic polypeptide
NFMLTQPPSVSGAPGQRVTISCSGSLSNIGASYDVHWYQQLPGAAPKLLVYANDNRPSGVPDRFSGSRSGTSASLAITGLQAEDEADYYCQSYDSSLSAQVFGEGTKLTVL

SEQ ID NO: 3536 - protein, 110 aa, Artificial Sequence
  Description of Artificial Sequence: Synthetic polypeptide
NFMLTQPHSVSESPGKTVTISCTRSSGSIASNYVQWYQQRPGSAPTTVIYEDNQRPSGVPDRFSGSIDSSSNSASLTISGLKTEDEADYYCQSYDSSNAVFGGGTQLTVL

SEQ ID NO: 3537 - protein, 110 aa, Artificial Sequence
  Description of Artificial Sequence: Synthetic polypeptide
QLVLTQPPSASGTPGQRVTISCSGSSSNIGSNYVYWYQQLPGTAPKLLIYRNNQRPSGVPDRFSGSKSGTSASLAITGLQAEDEADYFCATWDDSLRGPVFGGGTKLTVL

SEQ ID NO: 3538 - protein, 110 aa, Artificial Sequence
  Description of Artificial Sequence: Synthetic polypeptide
SYVLTQPPSASGTPGQRVTISCSGSSSNIGSNTVNWYQQFPGTAPQVVIYRNHQRPSGVPDRFSASKSGTSASLVITGLQSQDEADYYCATWDDRLDGLLFGGGTQLTVL

SEQ ID NO: 3539 - protein, 112 aa, Artificial Sequence
  Description of Artificial Sequence: Synthetic polypeptide
ESALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVL

SEQ ID NO: 3540 - protein, 109 aa, Artificial Sequence
  Description of Artificial Sequence: Synthetic polypeptide
EIVLTQSPSFLSASVGDRVTITCRASQDIRKSLNWYQQRPGKAPKLLISDASNLEAGVPSRFSGSGSGTDFTFTISNLQPEDFATYFCQQYHHLPPWTFGQGTKVEIKR

SEQ ID NO: 3541 - protein, 222 aa, Artificial Sequence
  Description of Artificial Sequence: Synthetic polypeptide
VKLQQSGVELVRPGTSVKMSCKAVGYTFTYDWIGWVKQRPGHGLEWIGDIYLGGGYINYNEKFKGKVILTADTSSSTAYMQLSSLTSEDSAIYYCARGHYDGSYFDYWGQGTTLTVSSAKTTAPSVYPLAPVCGDTSGSSVTLGCLVKGYFPEPVTLTWNSGSLSSGVHTFPAVLQSDLYTLSSSVTVTSSTWPSQSITCNVAHPASSTKVDKKIEPRGPTI

SEQ ID NO: 3542 - protein, 213 aa, Artificial Sequence
  Description of Artificial Sequence: Synthetic polypeptide
DVLMTQTPTIMSASIGEEITLTCSASSSVSHMHWYQHKSGTSPKLLIYITSYLASGVPSRFSGSGSGTFYSLTISSVEAEDAADYYCHQWSTFPSTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3543 - protein, 218 aa, Artificial Sequence
  Description of Artificial Sequence: Synthetic polypeptide
QVQLQQPGAELVRPGSSVKLSCKASGYTFTSKWMHWVKQRPIQGLEWIGNIDPSDSETHYNQKFKDKATLTVDKSSSTAYMQLSSLTSEDSAVYYCARGVTRGYFDVWGTGTTVTVSSAKTTAPSVYPLAPVCGGTTGSSVTLGCLVKGYFPEPVTLTWNSGSLSSGVHTFPALLQSGLYTLSSSVTVTSNTWPSQTITCNVAHPASSTKVDKKIEPR

SEQ ID NO: 3544 - protein, 118 aa, Artificial Sequence
  Description of Artificial Sequence: Synthetic polypeptide
QVQLVQSGSELKKPGASVKVSCKASGYTLTRYAMTWVRQAPGQGLEWMGWINTYTGNPTYVQGFTGRFVFSLDTSVSTAFLHITSLKAEDTAVYFCAREGGARGFDYWGQGTLVTVSS

SEQ ID NO: 3545 - protein, 123 aa, Artificial Sequence
  Description of Artificial Sequence: Synthetic polypeptide
QVQLQESGPGLVKPSETLSLTCTVSGDSISSYSWSWIRQPPGKGLEWIGYIHYTGSTNYNPSLKSRLTISVDASKNQFSLKLSSVTAADTAVYYCARDWGGYSSSWTYGMDVWGQGTTVTVSS

SEQ ID NO: 3546 - protein, 212 aa, Artificial Sequence
  Description of Artificial Sequence: Synthetic polypeptide
QIVLTQSPAIMSASPGEKVTMTCSASSSVTYMYWYQQKPGSSPRLLIYDTSNLASGVPVRFSGSGSGTSYSLTISRMEAEDAATYYCQQRTNYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNE

SEQ ID NO: 3547 - protein, 112 aa, Artificial Sequence
  Description of Artificial Sequence: Synthetic polypeptide
QSVLTQPPSVSGAPGQRVTISCTGSSSNIGASHDVHWYQQLPGTAPTLLIYVNSNRPSGVPDRFSGSKSGTSASLAITGLQAEDEADYYCQSYDSNLSGSAVFGGGTKLTVL

SEQ ID NO: 3548 - protein, 107 aa, Artificial Sequence
  Description of Artificial Sequence: Synthetic polypeptide
DIQMTQSPSSLSASVGDRVTITCRASQGISNSLAWYQQKPGKAPKLLLYAASRLESGVPSRFSGSGSGTDYTLTISSLQPEDFATYYCQQYYSTPYTFGQGTKLEIK

SEQ ID NO: 3549 - protein, 127 aa, Artificial Sequence
  Description of Artificial Sequence: Synthetic polypeptide
QVQLVESGGGLVQPGGSLRLSCAASGFTLDDYAIGWFRQVPGKEREGVACVKDGSTYYADSVKGRFTISRDNGAVYLQMNSLKPEDTAVYYCASRPCFLGVPLIDFGSWGQGTQVTVSSEPKTPKPQ

SEQ ID NO: 3550 - protein, 135 aa, Artificial Sequence
  Description of Artificial Sequence: Synthetic polypeptide
QVQLVESGGGLVQAGGSLRLSCATSGGTFSDYGMGWFRQAPGKEREFVAAIRRNGNGGNGIEYADSVKGRFTISRDNAKNTVHLQMNSLTPEDTAVYYCAASISGYAYNTIERYNYWGQGTQVTVSSEPKTPKPQ

SEQ ID NO: 3551 - protein, 137 aa, Artificial Sequence
  Description of Artificial Sequence: Synthetic polypeptide
QVQLVESGGGLVQAGGSLSLSCAASGGDFSRNAMAWFRQAPGKEREFVASINWTGSGTYYLDSVKGRFTISRDNAKNALYLQMNNLKPEDTAVYYCARSTVFAEITGLAGYQSGSYDYWGQGTQVTVSSEPKTPKPQ

SEQ ID NO: 3552 - protein, 137 aa, Artificial Sequence
  Description of Artificial Sequence: Synthetic polypeptide
QVQLVETGGGTVQTGGSLRLSCSASGGSFSRNAMGWFRQAPGKEREFVAAINWSASSTYYRDSVKGRFTVSRDNAKNTVYLHLNSLKLEDTAAYYCAGSSVYAEMPYADSVKATSYNYWGQGTQVTVSSEPKTPKPQ

SEQ ID NO: 3553 - protein, 131 aa, Artificial Sequence
  Description of Artificial Sequence: Synthetic polypeptide
QVQLVETGGGLVQAGGSLRLPCSFSGFPFDNYFVGWFRQAPGKEREGVSCISSSDGSTYYADSVKGRFTISRDNAKNTVYLQMNSLKPEDTAVYYCGADFLTPHRCPALYDYWGQGTQVTVSSAHHSEDPS

SEQ ID NO: 3554 - protein, 127 aa, Artificial Sequence
  Description of Artificial Sequence: Synthetic polypeptide
QVQLVESGGGLVQPGGSLRLHCAASGSIASIYRTCWYRQGTGKQRELVAAITSGGNTYYADSVKGRFTISRDNAKNTIDLQMNSLKPEDTAVYYCNADEAGIGGFNDYWGQGTQVTVSSAHHSEDPS

SEQ ID NO: 3555 - protein, 134 aa, Artificial Sequence
  Description of Artificial Sequence: Synthetic polypeptide
QVQLVESGGGLVQAGGSLRLSCAASGRTFSRSSMGWFRQAPGKEREFVASIVWADGTTLYGDSVKGRFTVSRDNVKNMVYLQMNNLKPEDTALYYCADNKFVRGLVAVRAIDYDYWGQGTQVTVSSEPKTPKPQ

SEQ ID NO: 3556 - protein, 135 aa, Artificial Sequence
  Description of Artificial Sequence: Synthetic polypeptide
QVQLVESGGLVQAGGSLRLSCAASGRADIIYAMGWFRQAPGKEREFVAAVDWSGGSTYYADSVKGRFTISRDNAKNSVYLQMNSLKPEDTAVYYCAARRSWYRDALSPSRVYEYDYWGQGTQVTVSSEPKTPKPQ

SEQ ID NO: 3557 - protein, 125 aa, Artificial Sequence
  Description of Artificial Sequence: Synthetic polypeptide
QVQLVETGGGLVQPGGSLTLSCAGSGGTLEHYAIGWFRQAPGKEHEWLVCNRGEYGSTVYVDSVKGRFTASRDNAKNTVYLQLNSLKPDDTGIYYCVSGCYSWRGPWGQGTQVTVSSAHHSEDPS

SEQ ID NO: 3558 - protein, 126 aa, Artificial Sequence
  Description of Artificial Sequence: Synthetic polypeptide
QVQLVESGGGLVQPGGSLKLSCRASGSIVSIYAVGWYRQAPGKQRELLAAITTDGSTKYSDSVKGRFTISRDNAKNTVYLQMNNLKPEDTAIYSCIGDAAGWGDQYYWGQGTQVTVSSEPKTPKPQ

SEQ ID NO: 3559 - protein, 129 aa, Artificial Sequence
  Description of Artificial Sequence: Synthetic polypeptide
QVQLVESGGGLVQAGGSLRLSCAASGSIVNFETMGWYRQAPGKERELVATITNEGSSNYADSVKGRFTISGDNAKNTVSLQMNSLKPEDTAVYYCSATFGSRWPYAHSDHWGQGTQVTVSSEPKTPKPQ

SEQ ID NO: 3560 - protein, 125 aa, Artificial Sequence
  Description of Artificial Sequence: Synthetic polypeptide
QVQLVETGGALVHTGGSLRLSCEVSGSTFSSYGMAWYRQAPGEQRKWVAGIMPDGTPSYVNSVKGRFTISRDNAKNSVYLHMNNLRPEDTAVYYCNQWPRTMPDANWGRGTQVTVSSEPKTPKPQ

SEQ ID NO: 3561 - protein, 117 aa, Artificial Sequence
  Description of Artificial Sequence: Synthetic polypeptide
QVQLVETGGSLRLTCVTSGSTFNNPAITWYRQPPGKQREWVASLRSGDGPVYRESVKGRFTIFRDNATDALYLRMNSLKPEDTAVYHCNTASPASWLDWGQGTQVTVSSEPKTPKPQ

SEQ ID NO: 3562 - protein, 130 aa, Artificial Sequence
  Description of Artificial Sequence: Synthetic polypeptide
QVQLVETGGGLVQPGGSLRLSCATSGFPFSTERMSWVRQAPGKGLEWVSGITEGGETTLAAPSVKGRFNISRDNARNILYLQMNSLKPEDAAVYYCFRGVFFRTSFPPELARGQGTQVTVSSEPKTPKPQ

SEQ ID NO: 3563 - protein, 127 aa, Artificial Sequence
  Description of Artificial Sequence: Synthetic polypeptide
QVQLVESGGGLVQAGGSLRLSCAASGSAVSDSFSTYAISWHRQAPGKQREWIAGISNRGATSYRDSVKGRFTISRDNAKNTVYLQMNNLKPEDTGVYYCEPWPREGLGGGQGTQVTVSSEPKTPKPQ

SEQ ID NO: 3564 - protein, 124 aa, Artificial Sequence
  Description of Artificial Sequence: Synthetic polypeptide
QVQLVESGGGSVQTGGSLTLSCVVSGSTFSDYAVAWYRQVPGKSRAWVAGVSTTGSTSYTDSVRGRFTISRDNHKKTVYLSMNSLKPEDTGIYYCNLWPFTNPPSWGQGTQVTVSSAHHSEDPS

SEQ ID NO: 3565 - protein, 132 aa, Artificial Sequence
  Description of Artificial Sequence: Synthetic polypeptide
QVQLVESGGAVVQPGGSLRLSCATSGFTFSDDRMSWARQAPGKGLEWVSGISTASEGFATLYAPSVKGRFTISRDNAKHMLYLQMDTLKPEDTAVYYCLRGVFFRTNIPPEVLRGQGTQVTVSSAHHSEDPS

SEQ ID NO: 3566 - protein, 126 aa, Artificial Sequence
  Description of Artificial Sequence: Synthetic polypeptide
QVQLVETGGDLVQPGGSLRLSCAASGSSFSRAAVGWYRQAPGKEREWVARLASGDMTDYTESVRGRFTISRDNAKHTVYLQMDNLKPEDTAVYYCKARIPPYYSIEYWGKGTRVTVSSEPKTPKPQ

SEQ ID NO: 3567 - protein, 124 aa, Artificial Sequence
  Description of Artificial Sequence: Synthetic polypeptide
QVQLVETGGGLVQAGGSLRLSCVVSSPLFNLYDMAWYRQAPGNQRELVAGILTDGRATYSDSVKGRFTISRNNLTNTVFLQMSSLKPEDTAVYYCNRKNSIYWDSWGQGTQVTVSSEPKTPKPQ

SEQ ID NO: 3568 - protein, 134 aa, Artificial Sequence
  Description of Artificial Sequence: Synthetic polypeptide
QVQLVESGGGLVQAGGSLRLSCVASGLTFSRYGMGWFRQAPGQERVVVSVISPDGGSAYYADSVKGRFTISRDNAKNTVYLQMSTLRFEDTGVYYCTAGPRNGATTVLRPGDYDYWGQGTQVTVSSEPKTPKPQ

SEQ ID NO: 3569 - protein, 125 aa, Artificial Sequence
  Description of Artificial Sequence: Synthetic polypeptide
QVQLVESGGGLVQPGGSLRLSCAASGSSFSRYAMRWYRQAPGKQRELVANINSRGTSNYADSVKGRFTISRDNAKNTVYLQMNSLKPEDTAVYYCNAEWLGRSEPSWGQGTQVTVSSEPKTPKPQ

SEQ ID NO: 3570 - protein, 126 aa, Artificial Sequence
  Description of Artificial Sequence: Synthetic polypeptide
QVQLVESGGGLVQPGGSLRLSCAASGFIFSLYTMRWHRQAPGKERELVATITSATGITNYADSVKGRFIISRDDAKKTGYLQMNSLKPEDTAVYYCNAVRTTVSRDYWGQGTQVTVSSEPKTPKPQ

SEQ ID NO: 3571 - protein, 125 aa, Artificial Sequence
  Description of Artificial Sequence: Synthetic polypeptide
QVQLVESGGGLVQPGGSLRLSCAASGIIFSIYTMGWYRQAPGKQRELVAAIPSGPSANATDSVGGRFTITRDNAENTVYLQMNDLKPEDTAVYYCNARRGPGIKNYWGQGTQVTVSSEPKTPKPQ

SEQ ID NO: 3572 - protein, 130 aa, Artificial Sequence
  Description of Artificial Sequence: Synthetic polypeptide
QVQLVESGGGLVQPGGSLSVSCAASGSIARPGAMAWYRQAPGKERELVASITPGGLTNYADSVTGRFTISRDNAKRTVYLQMNSLQPEDTAVYYCHARIIPLGLGSEYRDHWGQGTQVTVSSAHHSEDPS

SEQ ID NO: 3573 - protein, 123 aa, Artificial Sequence
  Description of Artificial Sequence: Synthetic polypeptide
QVQLVETGGGLVQPGGSLGLSCVVASGRSINNYGMGWYRQAPGKQRELVAQISSGGTTNYAGSVEGRFTISRDNVKKMVYLQMNSLKPEDTAVYYCNSLLRTFSWGQGTQVTVSSAHHSEDPS

SEQ ID NO: 3574 - protein, 133 aa, Artificial Sequence
  Description of Artificial Sequence: Synthetic polypeptide
QVQLVETGGLVQPGGSLRLSCAASGLTFSSTAMAWFRQAPGKEREFVARISGAGITIYYSDSVKDRFTISRNNVENTVYLQMNSLKTEDTAVYYCAARRNTYTSDYNIPARYPYWGQGTQVTVSSEPKTPKPQ

SEQ ID NO: 3575 - protein, 126 aa, Artificial Sequence
  Description of Artificial Sequence: Synthetic polypeptide
QVQLVETGGLVQPGGSLRLSCAASRSTTATIYSMNWYRQAPGKQRELVAGMTSDGQTNYATSVKGRFTISRDNAKNTVYLLMNSLKLEDTAVYYCYVKPWRLQGWDYWGQGTQVTVSSEPKTPKPQ

SEQ ID NO: 3576 - protein, 122 aa, Artificial Sequence
  Description of Artificial Sequence: Synthetic polypeptide
QVQLVESGGGLVQPGGSLRLSCAAPESIVNSRTMAWYRQAPGKQRERVATITTAGSPNYADSVKGRFAISRDNAKNTVYLQMNSLKPEDTAVYYCNTLLSTLPYGQGTQVTVSSAHHSEDPS

SEQ ID NO: 3577 - protein, 123 aa, Artificial Sequence
  Description of Artificial Sequence: Synthetic polypeptide
QVQLVESGGGLVQPGGSLGLSCVVASERSINNYGMGWYRQAPGKQRELVAQISSGGTTNYADSVEGRFTISRDNVKKMVHLQVNSLKPEDTAVYYCNSLLRTFSWGQGTQVTVSSEPKTPKPQ

SEQ ID NO: 3578 - protein, 126 aa, Artificial Sequence
  Description of Artificial Sequence: Synthetic polypeptide
QVQLVETGGGLVQPGGSLRLSCAASGFTFSSYRMSWYRQAAGKERDVVATITANGVPTGYADSVMGRFTISRDNAKNTVYLEMNSLNPEDTAVYYCNAPRLHTSVGYWGQGTQVTVSSEPKTPKPQ

SEQ ID NO: 3579 - protein, 135 aa, Artificial Sequence
  Description of Artificial Sequence: Synthetic polypeptide
QVQLVESGGGLVQAGNSLRLSCTASGVIFSIYTMGWFRQAPGKEREFVAAIGVADGTALVADSVTGRFTISRDNAKNTVYLHMNSLKPEDTAVYSCAAYLSPRVQSPYITDSRYQLWGQGTQVTVSSEPKTPKPQ

SEQ ID NO: 3580 - protein, 119 aa, Artificial Sequence
  Description of Artificial Sequence: Synthetic polypeptide
TGGGLVQAGGSLRLSCAASGRYAMGWFRQAPGKEREFVATISRSGAIREYADSVKGRFTISRDGAENTVYLEMNSLKPDDTAIYVCAEGRGATFNPEYAYWGQGTQVTVSSAHHSEDPS

SEQ ID NO: 3581 - protein, 12 aa, Artificial Sequence
  Description of Artificial Sequence: Synthetic peptide
HTSTYWWLDGAP

SEQ ID NO: 3582 - protein, 12 aa, Artificial Sequence
  Description of Artificial Sequence: Synthetic peptide
HQLPYQYWWLSP

SEQ ID NO: 3583 - protein, 4 aa, Artificial Sequence
  Description of Artificial Sequence: Synthetic peptide
YWWL

SEQ ID NO: 3584 - protein, 213 aa, Artificial Sequence
  Description of Artificial Sequence: Synthetic polypeptide
DIQMTQSPSSLSASVGDRVTITCRASQDIRNYLNWYQQKPGKAVKLLIYYTSRLLPGVPSRFSGSGSGTDYSLTISSQEQEDIGTYFCQQGNTLPWTFGQGTKVEIRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3585 - protein, 468 aa, Artificial Sequence
  Description of Artificial Sequence: Synthetic polypeptide
MDWIWRILFLVAAATGAHSQVQLVQSGAEVKKPGASVKVSCKASGYTFTSNAIQWVRQAPGQRLEWVGWINGGDGNTKYSQKFQGRVTISRDISASTAYMELSSLRSEDTAVYYCARHRLQRGGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3586 - protein, 470 aa, Artificial Sequence
  Description of Artificial Sequence: Synthetic polypeptide
MELGLCWLFLVAILKGVQCEVQLLESGGGLVQPGGSLRLSCSGSGFMFSSYAMSWVRQAPGKGLEWVSGISGSGGTTNYADSVKGRFTISRDNSKNTLYMQMNSLRAEDTAVYYCAKDGVYGRLGGSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 3587 - protein, 449 aa, Artificial Sequence
  Description of Artificial Sequence: Synthetic polypeptide
ELINLQESGPGLVKPSETLSLTCTVSGGAMNSHFWSWIRQSPGKGLEWIGYIYSGGTTNYDPSLKSRVAISIDTSKKQFSLKLRSVTAADTAVYYCARGDMVTGDPGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKTVERKCWARHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3588 - protein, 451 aa, Artificial Sequence
  Description of Artificial Sequence: Synthetic polypeptide
ELINLVQSGHEVKQPGASVKLSCKASGYSFSSYFVHWVRQAPGQGFEWMGMINPRGGSTNYAQKFQGRVTMTRETSTTTVYMELSGLRSDDSAVYYCARVNWAYGDYDFDYWGQGTLVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKTVERKCWARHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3589 - protein, 451 aa, Artificial Sequence
  Description of Artificial Sequence: Synthetic polypeptide
ELINLVESGGGLVQPGRSLRLSCAASGFTFDDYAMHWVRQVAGKGLEWVSGINWNSANIAYADSVKGRFTISRDNAKKLVYLQMHSLRAEDTAVYYCAKDMYGGGGYFFAKWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKTVERKCWARHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3590 - protein, 454 aa, Artificial Sequence
  Description of Artificial Sequence: Synthetic polypeptide
ELINLVESGGGLIQPGGSLRLSCTASGFTVNSMYMNWFRQAPGKGLEWVSIIYSDGSTFYADSVKGRFTISRDNSKNTLYLQLSSLRAEDTAVYYCARAPQYDLWTGPLYGMDVWGQGTTVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCWARHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3591 - protein, 450 aa, Artificial Sequence
  Description of Artificial Sequence: Synthetic polypeptide
LQESGPGLVKPSETLSLTCTVSGGSISGNYWSWIRQPAGKGLEWIGRIYISGSTTYKPSLKSRVTMSVDTSKNQFSLKLTSVTAADTAVYYCARDKDYFISGSYYNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKTVERKCWARHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3592 - protein, 457 aa, Artificial Sequence
  Description of Artificial Sequence: Synthetic polypeptide
ELINLVESGGGVVRPGRSLRLSCAASGIIFSSYTMHWVRQAPGKGLEWVALISYDGTNKNYGDSVTGRFTISRDNSKNTLYLQMNSLRPEDTAVYYCARARVIVPAGSNYNQYGMDVWGQGTTVTVSSASTKGPSVFPLAPSSKSTSGGTAALGCLVKDYFPEPVTVSWNSGALTNGVHTFPAVLQSSGLYSLSSVVTVPSSSLGTQTYICNVNHKPSNTKVDKTVERKCWARHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3593 - protein, 122 aa, Artificial Sequence
  Description of Artificial Sequence: Synthetic polypeptide
QVQLVESGGGVVQPGRSLRLSCAASGFAFDSTAMHWVRQAPGKGLEWVAVISTGGSTYYADSVKGRFTISRDNSNNTLYLQMNSLRAEDTAVYYCAKAVRGYIGSRGPLDVWGQGTMVTVSS

SEQ ID NO: 3594 - protein, 133 aa, Artificial Sequence
  Description of Artificial Sequence: Synthetic polypeptide
LEQVQLVESGGGLVQPGGSLRLSCAASGFTFSRFWMNWVRQAPGKGLEWVANIKQDGSGKYYVDSVKGRFTISRDNAKNSLYLQMDSLRAEDTAVYYCARARTNGGYDIYYYYDMDVWGQGTTVTVSSASTKG

SEQ ID NO: 3595 - protein, 121 aa, Artificial Sequence
  Description of Artificial Sequence: Synthetic polypeptide
LEQVQLVESGGGLVQPGGSPRLSCAASGFTFSTDWMNWVRQAPGKGLECVANINQDGSERYYVDSVKGRFTISRDNAKNSLYLQMNSLRAEDTAVYYCVRNARGDWGQGTLVTVSSASTKG

SEQ ID NO: 3596 - protein, 136 aa, Artificial Sequence
  Description of Artificial Sequence: Synthetic polypeptide
LEEVQLLESGGGLVKPGGSLRLSCAGSGFTFRSYNMNWVRQAPGKGLEWASAITSTGSDIYYADSVRGRFTISRDNAQNSLLLQMNSLRAEDTAVYYCARDPGRGYGPNALGPYFYGMDVWGPGTTVTVSSASTKG

SEQ ID NO: 3597 - protein, 132 aa, Artificial Sequence
  Description of Artificial Sequence: Synthetic polypeptide
LEQVQLVESGGGLVKPGGSLRLSCAASGFTFSDYSMTWIRQAPGKGLEWISYITGSGSAISYADSVKGRFTISRDNANNSLFQQMNSLGAEGTALYYCARDREYGDSLLYFYGMDVWGQGTTVTVSSASTKG

SEQ ID NO: 3598 - protein, 126 aa, Artificial Sequence
  Description of Artificial Sequence: Synthetic polypeptide
LEEVQLLESGGGLVKPGGSLRLSCAASGFTFSSYGMNWVRQTPGKGLEWVASITDRGTYKDYAESLRGRFTISRDNAQNSMSLQMDSLTAEDTAVYFCARERFGDDGMDVWGQGTTVTVSSASTKG

SEQ ID NO: 3599 - protein, 130 aa, Artificial Sequence
  Description of Artificial Sequence: Synthetic polypeptide
LEEVQLVESGGGLVQPGESLRLSCEASGFTFPDYAMHWVRQRPGKGLEWVSVINWNGITRRYAASVKGRFIIDRDSAKNSLYLQMSSLRPEDTALYYCARDRDGGGNGGSGMDVWGQGTTVIVSSASTKG

SEQ ID NO: 3600 - protein, 134 aa, Artificial Sequence
  Description of Artificial Sequence: Synthetic polypeptide
LEQVQLVESGEGEVQPGRSLRLSCAASGFIFRSFGMHWVRQAPGKGLEWVAAISYDGTNKDYGDSVKGRFTISRDNSRNMVYLQMNSLRAEDTAVYYCAKEGVIIPAATKDRSNYFDYWGQGTLVTVSSASTKG

SEQ ID NO: 3601 - protein, 134 aa, Artificial Sequence
  Description of Artificial Sequence: Synthetic polypeptide
LEQVQLVESGGGEVQPGRSLRLSCAASGFIFRSFGMHWVRQAPGKGLEWVAAISYDGTNKDYGDSVKGRFTISRDNSRNMVYLQMNSLRAEDTAVYYCAKEGVIIPAATKDRSNYFDYWGQGTLVTVSSASTKG

SEQ ID NO: 3602 - protein, 134 aa, Artificial Sequence
  Description of Artificial Sequence: Synthetic polypeptide
LEQVQLVESGGGEVQPGRSLRLSCAASGFIFRSFGMHWVRQAPGKGLEWVAAISYDGTNKDYGDSVKGRFTISRDNFRNMVYLQMNSLRAEDTAVYYCAKEGVIIPAATKDRSNYFDYWGQGTLVTVSSASTKG

SEQ ID NO: 3603 - protein, 134 aa, Artificial Sequence
  Description of Artificial Sequence: Synthetic polypeptide
LEQVQLVESGGGEVQPGRSLRLSCAASGFIFRSFGMHWVRQAPGKGLEWVAATSYDGTNKDYGDSVKGRFTISRDNSRNMVYLQMNSLRAEDTAVYYCAKEGVIIPAATKDRSNYFDYWGQGTLVTVSSASTKG

SEQ ID NO: 3604 - protein, 134 aa, Artificial Sequence
  Description of Artificial Sequence: Synthetic polypeptide
LEEVQLVESGGGEVQPGRSLRLSCAASGFIFRSFGMHWVRQAPGKGLEWVAAISYDGTNKDYGDSVKGRFTISRDNSRNMVYLQMNSLRAEDTAVYYCAKEGVIIPAATKDRSNYFDYWGQGTLVTVSSASTKG

SEQ ID NO: 3605 - protein, 134 aa, Artificial Sequence
  Description of Artificial Sequence: Synthetic polypeptide
LEEVQLVESGGGEVQPGRSLRLSCAASGFIFRSFGMHWVRQAPGKGLEWVAAISYDGTNKDYGDSVKGRFTISRDNSRNMVYLQMNSLRAEDTAVYYCAKEGVIIPAATKDRSNYFDYWGQGTLVTVSSASAKG

SEQ ID NO: 3606 - protein, 134 aa, Artificial Sequence
  Description of Artificial Sequence: Synthetic polypeptide
LEQVQLVESGGGEVQPGRSLRLSCAASGFIFRSFGMHWVRQAPGKGLEWVAAISYDGTNKDYGDSVKGRFTISRDNSRNVVYLQMNSLRAEDTAVYYCAKEGVIIPAATKDRSNYFDYWGQGTLVTVSSASTKG

SEQ ID NO: 3607 - protein, 134 aa, Artificial Sequence
  Description of Artificial Sequence: Synthetic polypeptide
LEQVQLVESGGGVVQPGMSLRLSCAASGFIFSSYGMHWVRQAPGKGLEWVAVIPYDGTNKYYADSVKGRFTISRDNSKNTVYLQMNSLRAEDTAVYYCAKEGVIIPAATNDRSNYFDYWGQGTLVTVSSASTKG

SEQ ID NO: 3608 - protein, 134 aa, Artificial Sequence
  Description of Artificial Sequence: Synthetic polypeptide
  MOD_RES (40)..(40): Any amino acid
  MOD_RES (98)..(98): Any amino acid
  MOD_RES (107)..(107): Any amino acid
LEEVQLLESGGGVVQPGTSLRLSCAASGFIFSSYGMHWVXQAPGKGLEWVAVIPYDGTNKYYADSVKGRFTISRDNSKNTVYLQMNSLRAEDTAVYYXAKEGVIIPXSTNDRSNYFDYWGQGTLVTVSSASTKG

SEQ ID NO: 3609 - protein, 134 aa, Artificial Sequence
  Description of Artificial Sequence: Synthetic polypeptide
LEQVQLVESGGGVVQPGRSLRLSCAASGFIFSSYGIHWVRQAPGKGLEWVALISYDGSNKYYADSVKGRFTISRDNSKNTLYLQMNSLRAEDTAVYYCAKEGVIIPAATNDRSNYFDYWGQGTLVTVSSASTKG

SEQ ID NO: 3610 - protein, 134 aa, Artificial Sequence
  Description of Artificial Sequence: Synthetic polypeptide
  MOD_RES (81)..(81): Any amino acid
  MOD_RES (110)..(110): Any amino acid
LEQVQLVESGGGVVQPGRSLRLSCAASGFIFSSYGIHWVRQAPGKGLEWVALISYDGSNKYYADSVKGRFTISRDNSKNTXYLQMNSLRAEDTAVYYCAKEGVIIPAATXDRSNYFDYWGQGTLVTVSSASTKG

SEQ ID NO: 3611 - protein, 135 aa, Artificial Sequence
  Description of Artificial Sequence: Synthetic polypeptide
LEEVQLVESGGGVVQPGRSLRLSCAASRFIFSSYGMHWVRQAPGKGLEWVAVISYDGSNKHYADSVKGRFTISRDNSKNTLYLQMNSLRAEDTAVYYCAKNRVIVPARNVDYIYYGMDVWGQGTTVTVSSASTKG

SEQ ID NO: 3612 - protein, 135 aa, Artificial Sequence
  Description of Artificial Sequence: Synthetic polypeptide
LEEVQLVESGGGVVQPGRSLRLSCAASRFIFSSYGMHWVRQAPGKGLEWVAVISYDGSNKHYADSVKGRFTISRDNSKNTLYLQMNSLRAEDTAVYYCAKNRVIVPARNVDYIYYGMDAWGQGTTVTVSSASTKG

SEQ ID NO: 3613 - protein, 135 aa, Artificial Sequence
  Description of Artificial Sequence: Synthetic polypeptide
LEEVQLVESGGGVVQPGRSLRLSCVGSGLIFSSYGMHWVRQAPGKGLEWVALISYDGSKKYYADSVKGRFTISRDNSKNTLYLQMNSLRATDTAVYFCAKDRVIVPAANDYYFYYGMDVWGQGTTVTVSSASTKG

SEQ ID NO: 3614 - protein, 135 aa, Artificial Sequence
  Description of Artificial Sequence: Synthetic polypeptide
  MOD_RES (26)..(26): Any amino acid
LEEVQLVESGGGVVQPGRSLRLSCAXSGFIFSSYGLHWVRQAPGKGLEWVAFISYDGSKKNYADSVKGRFIISRDNSKNTLYLQMNSLRAEDTAVYYCAKDRVIVPAANKYYYYYGMDVWGQGTTVTVSSASTKG

SEQ ID NO: 3615 - protein, 137 aa, Artificial Sequence
  Description of Artificial Sequence: Synthetic polypeptide
LEQVQLVESGGGVVQPGRSLRVSCAASGFIFRSYGMHWVRQAPGKGLEWVAVISYDGSKKYYGDSVKGRFTISRDNSKNMVYLQMNSLRPEDTAVYYCTKDRIIVPAQNHPTGFYYYGMDVWGQGATVTVSSASTKG

SEQ ID NO: 3616 - protein, 134 aa, Artificial Sequence
  Description of Artificial Sequence: Synthetic polypeptide
  MOD_RES (101)..(101): Any amino acid
LEQVQLVQSGGGVVQPGRSLRLSCAASGFIFGSYAMYWVRQAPGKGLEWVALISYDGSIKYYADSVKGRFTISRDKSNKTLFLQMSSLRPEDTAVYYCARXGVIVPASTRTRYYRMDVWGQGTAVSVSSASTKG

SEQ ID NO: 3617 - protein, 129 aa, Artificial Sequence
  Description of Artificial Sequence: Synthetic polypeptide
LEQVQLVESGGGVVQPGGSLRLSCTASAFTFRDFGMHWVRQAPGKGLEWVALISHDGAQTSYVDSVKGRFTISRDNSKETVFLQMSGLRPEDTAIYYCSKSTAKTYYYYGMDVWGPGTAVTASSASTKG

SEQ ID NO: 3618 - protein, 138 aa, Artificial Sequence
  Description of Artificial Sequence: Synthetic polypeptide
LEQVQLVESGGGVVQPGGSLRLSCAASGFNFDDYAMHWVRQAPGKGREWVSLISEDGYNTYYADSVKGRFTISRDNSKNSLYLQMNNLGPEDTAFYFCAKAGPQRRYYDRLPGYYPSYYFDSWGQGTLVSVSSASTKG

SEQ ID NO: 3619 - protein, 127 aa, Artificial Sequence
  Description of Artificial Sequence: Synthetic polypeptide
LEEVQLLESGGGLVQPGGSLRLSCAASGFTYRSWGMSWVRQAPGKGLEWVSAISASGGSTYYADSVRGRFTISRDNSKNTLYLQMNSLRAEDTAVYYCAKGTLVAPDGSDSWGQGTLVTVSSASTKG

SEQ ID NO: 3620 - protein, 133 aa, Artificial Sequence
  Description of Artificial Sequence: Synthetic polypeptide
LEEVQLVESGGGLVQPGGSLRLSCSASGFTFSNYALTWVRQVPGKGLEWVSGISARSGSTYYADSVKGRFTISRDNSKNTMYVQMDSLRAEDTALYYCARYKLAYCTGDCYPYAFDIWGQGTMVTVSSASTKG

SEQ ID NO: 3621 - protein, 132 aa, Artificial Sequence
  Description of Artificial Sequence: Synthetic polypeptide
LEEVQLVESGGGLAQPGGSLRLPCVVSGYTLRNYAVSWVRQAPGKGLEWVSSVSGSGSDAYYADSVKGRFTISRDISKDTLFLQMNSLRSEDTAVYYCARLYSSGWDFYHYYGMDVWGQGTTVTVSSASTKG

SEQ ID NO: 3622 - protein, 126 aa, Artificial Sequence
  Description of Artificial Sequence: Synthetic polypeptide
LEQMQLVQSGGGLVQPGGSLRLSCAASGFTLSDHYMDWVRQAPGKGLDWVGRTKNKANSYTIEYAASVKGRFTISRDDSKNSFYLQMNSLKAEDTAVYYCARWTSGACNYWGQGTLVTVSSASTKG

SEQ ID NO: 3623 - protein, 124 aa, Artificial Sequence
  Description of Artificial Sequence: Synthetic polypeptide
LEQVQLVQSGAEVKKPGASVKVSCKASGYTFTYYAMHWVRQAPGQRPEWMGWINGGDGKTKYAQKFQGRLAITRDTSARTAYMELISLTSEDTAVYYCAKGAEMTVGSWGPGTLVTVSSASTKG

SEQ ID NO: 3624 - protein, 136 aa, Artificial Sequence
  Description of Artificial Sequence: Synthetic polypeptide
LEQVQLVQSGAEVKKPGASVKVSCKASGYTFTGYYMHWVRQAPGQGLEWMGWINPNTGDTNYAQNFQGWVTMTRDTSIRTAYTELSRLRSDDTAVYYCARDFYSDSSGYYYGYYSYGMDVWGQGTTVTVSSASTKG

SEQ ID NO: 3625 - protein, 134 aa, Artificial Sequence
  Description of Artificial Sequence: Synthetic polypeptide
LEQVQLVQSGAEVKKPGSSVKVSCKASGGNFNTFAISWVRQAPGQGLEWMGRIIPIVGIADYAQKFQGRVTITADKSTSTAYMELSSLRSEDTAVYYCARDESGYTNRGTYYYYGTDVWGQGTTVTVSSASTKG

SEQ ID NO: 3626 - protein, 134 aa, Artificial Sequence
  Description of Artificial Sequence: Synthetic polypeptide
LEQVQLVQSGAEVKKPGSSVKVSCKASGGNFNTFAISWVRQAPGQGLEWMGRIIPIVGIADYAQKFQGRVTITADKSTGTAYMELSSLRSEDTAVYYCARDESGYTNRGTYYYYGTDVWGQGTTVTVSSASTKG

SEQ ID NO: 3627 - protein, 134 aa, Artificial Sequence
  Description of Artificial Sequence: Synthetic polypeptide
LEQMQLVQSGAEVKKPGSSVKVSCKASGGTFSNYATSWVRQAPGQGLEWLGGIIPVFGTANYAQKFQGRVTITADESTSTAYMELNSLTFDDTAVYYCARGGGGWGGRNYYYYYYMDVWGKGTTVTVSSASTKG

SEQ ID NO: 3628 - protein, 128 aa, Artificial Sequence
  Description of Artificial Sequence: Synthetic polypeptide
LEQVQLVQSGAEVKKPGESLKISCKASGYSFTTHWIGWVRQMPGKGLEWMGIIYPDDSDTKYGPSFQGEVTISCDKSINTAYLQWRSLKASDTAMYYCARYRRQLNPYAFDMWGQGTMVTVSLASTKG

SEQ ID NO: 3629 - protein, 110 aa, Artificial Sequence
  Description of Artificial Sequence: Synthetic polypeptide
SREIVMTQSPATLSVSPGDTATLSCRASQSVGSNLAWYQQKPGQAPRLLIHGASTRATGIPGRFSGAGSGTEFTLTISSLQSDDFAVYYCQQYHNWPPLTFGGGTKVEIK

SEQ ID NO: 3630 - protein, 112 aa, Artificial Sequence
  Description of Artificial Sequence: Synthetic polypeptide
SRQSALTQPHSASGPPDQTVTISCSGSSSNIEGNTVNWYQQFPGKAPQLLIYGKDQRPSGVPDRFSASKSGTSASLTISGLQAEDEADYYCAAWDDSLNGWVFGGGTKLTVL

SEQ ID NO: 3631 - protein, 110 aa, Artificial Sequence
  Description of Artificial Sequence: Synthetic polypeptide
SRSYVLTQPPSVSVAPGQTARITCGGNNIGSKSVHWYQQRPGQAPVLVVYDDSDRPSGIPDRFSGSNSGNTATLTISRVEAGDEADYHCQVWDSSSDHVVFGGGTKLTVL

SEQ ID NO: 3632 - protein, 123 aa, Artificial Sequence
  Description of Artificial Sequence: Synthetic polypeptide
EVQLLESGGGLIQPGGSLRLSCAASGFSVGTNSMTWVRQAPGKGLEWVSFISIGGTTYEADSVKGRFTISRDSSKNTLYLQMNTLRAEDTAVYYCASQLWFGELFGHDVFDIWGQGTVVTVSS

SEQ ID NO: 3633 - protein, 129 aa, Artificial Sequence
  Description of Artificial Sequence: Synthetic polypeptide
  MOD_RES (66)..(66): Any amino acid
  MOD_RES (92)..(92): Any amino acid
EVQLVESGGGVVQPGRSLRLSCAASGFTFDRYGMHWVRQAPGKGPEWVAVISHDGSHEEYADSGKXRFTISRDNSKNTLYLQMNSLRAEDTXVYYCAKDGAYYYDYSGYPYDYNGIDVWGQGTTVVVSS

SEQ ID NO: 3634 - protein, 123 aa, Artificial Sequence; identical to SEQ ID NO: 3632
  Description of Artificial Sequence: Synthetic polypeptide

SEQ ID NO: 3635 - protein, 247 aa, Artificial Sequence
  Description of Artificial Sequence: Synthetic polypeptide
DIQMTQTTSSLSASLGDRVTISCRASQDIRNYLNWYQQKPDGTVKLLIYYTSRLQSGVPSRFSGSGSGTDYSLTISNQEQEDIGTYFCQQGNTLPWTFGGGTKLEIKRGGGGSGGGGSGGGGSGGGGSEVQLQQSGPELVKPGASVKISCKDSGYAFSSSWMNWVKQRPGQGLEWIGRIYPGDGDTNYNGKFKGKATLTADKSSSTAYMQLSSLTSVDSAVYFCARSGLLRYAMDYWGQGTSVTVSS

SEQ ID NO: 3636 - protein, 121 aa, Artificial Sequence
  Description of Artificial Sequence: Synthetic polypeptide
EVQLLETGGGLVQPGGSLRLSCAASGFTLRSYHMSWVRRAPGKGLEWVSVIYDGGSTSYADSVKGRFTISRDNSKNTLYLQMTSLRAEDTAVYYCARSGRPLQNYYYMDVWGKGTTVTVSS

SEQ ID NO: 3637 - protein, 121 aa, Artificial Sequence
  Description of Artificial Sequence: Synthetic polypeptide
EVQLVETGGGLVQPGGSLRLSCAASGFTLRSYHMSWVRKAPGKGLEWVSVIYDGGSTSYADSVKGRFTISRDNSKNTLYLQMTSLRAEDTAVYYCARSGRPLQNYYYMDVWGKGTTVTVSS

SEQ ID NO: 3638 - protein, 125 aa, Artificial Sequence
  Description of Artificial Sequence: Synthetic polypeptide
QVQLQESGPGLVKPSQTLSLTCAVSADSITSGYYYWNWIRQPPGKGLEWIAYIDYRGTTTYNPSLKSRVTMSLDTSKNQFSLKLSSVTAADTAVYYCARGGGYPQYGDYAWFDPWGQGTTVTVSS

SEQ ID NO: 3639 - protein, 125 aa, Artificial Sequence
  Description of Artificial Sequence: Synthetic polypeptide
EVQLVETGGGFVKPGGSLRVSCAASGFTFSDYAMHWVRQAPEKGLEWVSTISGSGTSWTYNPSLKSRFTISRDNSKNTLYLQMNSLRAEDTAVYYCARNPMVGVPQFYYYYIDPWGKGTTVTVSS

SEQ ID NO: 3640 - protein, 124 aa, Artificial Sequence
  Description of Artificial Sequence: Synthetic polypeptide
EVQLVETGGGVVQPGRSLRLSCAASGFTFSSYGMHWVRQAPGKGLEWVAFIAFDEGNQHYNPSLRSRFTISRDNSKNTLYLQMNRLRTEDTAVYYCVRGRAAGHPGASYYFDYWGQGTPVTVSS

SEQ ID NO: 3641 - protein, 129 aa, Artificial Sequence
  Description of Artificial Sequence: Synthetic polypeptide
EVQLVESGAEVKKPGESLKISCKASGYSFTNYWIGWVRQMPGKGLEWMGSIYPGDSDTRYSPSFQSQVTISADKSINTAYLQWSSLKASDTAIYYCARVGIYCSGNTCLAPSGYYMDVWGNGTTVTVSS

SEQ ID NO: 3642 - protein, 449 aa, Artificial Sequence
  Description of Artificial Sequence: Synthetic polypeptide
QVQLQQSGPELKKPGASVKVSCKDSGYAFSSSWMNWVRQAPGQGLEWIGRIYPGDGDTNYNGKFQGRVTITADKSSSTAYMELSSLRSEDTAVYFCARSGLLRYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKCQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3643 - protein, 125 aa, Artificial Sequence
  Description of Artificial Sequence: Synthetic polypeptide
QVQLQESGPGLLKPSETLSLTCAVSGDSISGGYYWSWIRQSPGKGLEWIGLIYGSTADTRYNPSLKGRVTISKDTSKNQLSLQLRSVTAADTAVYYCARSGYNFWSGEYYGLDSWGQGAVVTVSS

SEQ ID NO: 3644 - protein, 103 aa, Artificial Sequence
  Description of Artificial Sequence: Synthetic polypeptide
TQSPSSLSAYVGDKVTITCHASQGINSWLAWYQQKPGKAPKLLIYKASSLQSGVPSRFSGSGSGTDYTLTISSLQSEDFASYYCLQYDSAPLAFGPGTKLDIK

SEQ ID NO: 3645 - protein, 121 aa, Artificial Sequence
  Description of Artificial Sequence: Synthetic polypeptide
  MOD_RES (3)..(3): Any amino acid
  MOD_RES (13)..(13): Any amino acid
  MOD_RES (16)..(16): Any amino acid
  MOD_RES (28)..(28): Any amino acid
  MOD_RES (50)..(51): Any amino acid
  MOD_RES (53)..(53): Any amino acid
  MOD_RES (55)..(56): Any amino acid
  MOD_RES (64)..(65): Any amino acid
  MOD_RES (67)..(67): Any amino acid
  MOD_RES (72)..(72): Any amino acid
  MOD_RES (76)..(76): Any amino acid
  MOD_RES (93)..(93): Any amino acid
  MOD_RES (95)..(95): Any amino acid
  MOD_RES (102)..(102): Any amino acid
  MOD_RES (104)..(104): Any amino acid
  MOD_RES (106)..(108): Any amino acid
  MOD_RES (111)..(111): Any amino acid
  MOD_RES (117)..(117): Any amino acid
LEXSGGGLVKPGXSLXLSCAASGFTFSXYAMHWVRQAPEKGLEWVSTIGXXGXTXXSDSVKGRXXIXRDNSXNTLXLQMNSLRAEDTAVYYCXRXGYCSSTXCXSXXXFDXWGQGTXVTVS

SEQ ID NO: 3646 - protein, 121 aa, Artificial Sequence
  Description of Artificial Sequence: Synthetic polypeptide
LEESGGGLVKPGDSLRLSCAASGFTFSVYAMHWVRQAPEKGLEWVSTIGAGGNTWHSDSVKGRYTIARDNSQNTLSLQMNSLRAEDTAVYYCVRRGYCSSTRCDSNDAFDIWGQGTMVTVS

SEQ ID NO: 3647 - protein, 120 aa, Artificial Sequence
  Description of Artificial Sequence: Synthetic polypeptide
LESGGGLVKPGGSLTLSCAASGFTFSTYAMHWVRQAPEKGLEWVSTIGRSGDTLYSDSVKGRFSISRDNSKNTLYLQMNSLRAEDTAVYYCARKGYCSSTNCQSQYYFDYWGQGTLVTVS

SEQ ID NO: 3648 - protein, 122 aa, Artificial Sequence
  Description of Artificial Sequence: Synthetic polypeptide
PFEVQLEESGGDLVKPGGSLKLSCAASGFTFSDYGMSWIRQTPDRRLEWVATISTGGTYTYYLDSVKGRFTISRDNAKNTLYLQMNSLKSEDTAMYYCSNDDLGQGTSVTVSSAKTTPPSKG

SEQ ID NO: 3649 - protein, 125 aa, Artificial Sequence
  Description of Artificial Sequence: Synthetic polypeptide
PFEVQLEESGPELVKPGASVKVSCKASGYSFTDYNMYWVKQSHGTSLEWIGVIDPNNGVTSYNQKFKDKATLTADKSSSTAFMHLNSLTSEDSAVYYCSRGGLDYWGQGTTLTVSSAKTTPPSKG

SEQ ID NO: 3650 - protein, 134 aa, Artificial Sequence
  Description of Artificial Sequence: Synthetic polypeptide
NSPFEVQLEESGPELVSPGVSVKISCEGSGYTFTDYAMHWVKQSHARGLEWIGVIGSYSGNAHHNLNFKDKATMTVDKSSSTAYMELARLTSDDSAIYYCAYTRTTLWATLGLPEATGLWSLSLQPKRHPHLRA

SEQ ID NO: 3651 - protein, 125 aa, Artificial Sequence
  Description of Artificial Sequence: Synthetic polypeptide
QVQLQESGPGLLKPSETLSLTCAVSGDSISSGYYWSWIRQSPGKGLEWIGHIYGSTADTKYNPSLRSRVTISKDTSKNQLSLQLRSVTAADTAVYYCARSGYNFWSGEYYGLDSWGQGAVVTVSS

SEQ ID NO: 3652 - protein, 125 aa, Artificial Sequence; identical to SEQ ID NO: 3643
  Description of Artificial Sequence: Synthetic polypeptide

SEQ ID NO: 3653 - protein, 125 aa, Artificial Sequence
  Description of Artificial Sequence: Synthetic polypeptide
QVQLQESGPGLLKPSETLSLTCAVSGDSISGGYYWSWIRQSPGKGLEWIGHIYGSTADTRYNPSLKSRVTISKDTSKNQLSLQLRSVTAADTAVYYCARSGYNFWSGEYYGLDLWGQGAVVTVSS

SEQ ID NO: 3654 - protein, 125 aa, Artificial Sequence
  Description of Artificial Sequence: Synthetic polypeptide
QVQLQESGPGLLKPSETLSLTCAVSGDSISGGYYWSWIRQSPGKGLEWIGHIYGSTADTRYNPSLKSRVTISKDTSKNQLSLQLRSVTAADTAVYYCARSGYNFWSGEYYGLDSWGQGAVVTVSS

SEQ ID NO: 3655 - protein, 125 aa, Artificial Sequence
  Description of Artificial Sequence: Synthetic polypeptide
QVQLQESGPGLVKPSETLSLTCTVSGDSISSGYYWSWIRQPPGKGLEWIGHIYGSTADTNYNPSLRSRVTISKDTSKNQFSLQLSSVTAADTAVYYCARSGYNFWSGEYYGLDSWGQGTLVTVSS

SEQ ID NO: 3656 - protein, 125 aa, Artificial Sequence
  Description of Artificial Sequence: Synthetic polypeptide
QVQLQESGPGLVKPSETLSLTCTVSGDSISGGYYWSWIRQPPGKGLEWIGLIYGSTADTNYNPSLKGRVTISKDTSKNQFSLQLSSVTAADTAVYYCARSGYNFWSGEYYGLDSWGQGTLVTVSS

SEQ ID NO: 3657 - protein, 125 aa, Artificial Sequence
  Description of Artificial Sequence: Synthetic polypeptide
QVQLQESGPGLVKPSETLSLTCTVSGDSISGGYYWSWIRQPPGKGLEWIGHIYGSTADTNYNPSLKSRVTISKDTSKNQFSLQLSSVTAADTAVYYCARSGYNFWSGEYYGLDLWGQGTLVTVSS

SEQ ID NO: 3658 - protein, 125 aa, Artificial Sequence
  Description of Artificial Sequence: Synthetic polypeptide
QVQLQESGPGLVKPSETLSLTCTVSGDSISGGYYWSWIRQPPGKGLEWIGHIYGSTADTNYNPSLKSRVTISKDTSKNQFSLQLSSVTAADTAVYYCARSGYNFWSGEYYGLDSWGQGTLVTVSS

SEQ ID NO: 3659 - protein, 123 aa, Artificial Sequence
  Description of Artificial Sequence: Synthetic polypeptide
QVQLVESGGGVVQPGRSLRLSCAASGFTFSYYGMHWVRQAPGKGLEWVAVIWHDESIVYYADSVKGRFTISRDNSKNTLYLQMNSLRAEDTAVYYCTRDPGDPYYYYYGLDVWGQGTTVTVSS

SEQ ID NO: 3660 - protein, 118 aa, Artificial Sequence
  Description of Artificial Sequence: Synthetic polypeptide
QVQLVESGGGVVQPGRSLRLSCAASGFTFSSYGMHWVRQAPGKGLEWVAVIWNDGSNKYYADSVKGRFTISRDNSKNTLYLQMNSLRAEDTAVYYCARENWGEYFDYWGQGTLVTVSS

SEQ ID NO: 3661 - protein, 129 aa, Artificial Sequence
  Description of Artificial Sequence: Synthetic polypeptide
EVHLVESGGGLVQPGGSLRLSCAASGFTFSSYWMSWVRQAPGKGLEWVANINQYGSEKYYVDSVKGRFTISRDNAKNSLYLQMNSLRAEDTAVYYCARDSPYYYGSGSYYRGYWYFDLWGRGTLVTVSS

SEQ ID NO: 3662 - protein, 121 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCAREGNRSHYIPFAYWGQGTLVTVSS

SEQ ID NO: 3663 - protein, 118 aa, Artificial Sequence
  Description of Artificial Sequence: Synthetic polypeptide
QVKLQESGAELVRPGASVKLSCKTSGYIFTNYWIHWVKQRSGQGLERIARIYPGTGGTYYNEKFKGKATLTADKSSSTAYMQLSSLKSEDSAVYFCARWDLHFSMDYWGQGTTVTVSS

SEQ ID NO: 3664 - protein, 115 aa, Artificial Sequence
  Description of Artificial Sequence: Synthetic polypeptide
EVKLQESGGGLVQPGGSMKLSCAASGFSFSDAWMDWVRQSPEKGLEWVAEIRSKAKNHATFYAESVKGRFTISRDDSKSSVYLQMNSLRGEDTGIYYCTAGTGVWGQGTTVTVSS

SEQ ID NO: 3665 - protein, 112 aa, Artificial Sequence
  Description of Artificial Sequence: Synthetic polypeptide
EVQLQQSGAELVKPGASVKLSCTASGFNIKDSFIHWVKQRPEQGLDWIGRIDPANGNTKYDPKFQGKATLTADTSSNTAYLQLSSLTSEDTAVYYCTRLDYWGQGTALTVSS

SEQ ID NO: 3666 - protein, 247 aa, Artificial Sequence
  Description of Artificial Sequence: Synthetic polypeptide
DIQMTQTTSSLSASLGDRVTVSCRASQDIRNYLNWYQQKPDGTVKFLIYYTSRLQPGVPSRFSGSGSGTDYSLTINNLEQEDIGTYFCQQGNTPPWTFGGGTKLEIKRGGGGSDGGGSGGGGSGGGGSEVQLQQSGPELVKPGASVKISCKDSGYAFNSSWMNWVKQRPGQGLEWIGRIYPGDGDSNYNGKFEGKAILTADKSSSTAYMQLSSLTSVDSAVYFCARSGLLRYAMDYWGQGTSVTVSS

SEQ ID NO: 3667 - protein, 121 aa, Artificial Sequence
  Description of Artificial Sequence: Synthetic polypeptide
QVQLQQSGGAVVQPGGSLRLSCAASGFTLDDYAMHWVRQVSGKGLEWVCLVSWDGHATHYADSVKGRFTISRDNSRNSLFLQMDGLRPEDTALYYCVKAFSSGWSDAFHFWGQGTLVTVSS

SEQ ID NO: 3668 - protein, 125 aa, Artificial Sequence
  Description of Artificial Sequence: Synthetic polypeptide
QVQLQQSGGGLVQPGGSLKLSCAASGFTFSDSAIHWVRQASGKGLEWVGRIRSKANGYATAYTASVKGRFTISRDDSLNTAYLQMNSLKTEDTAVYYCTRHDSTTWFLRDVFDIWGQGTKVTVSS

SEQ ID NO: 3669 - protein, 126 aa, Artificial Sequence
  Description of Artificial Sequence: Synthetic polypeptide
QVQLLESGPGLVKPSETLSLTCTVSGASISTKSYSWGWIRQPPGKGLEWIGIAYNSGRTYFNPSLKSRVTISVDTSKNRFSLQLTSVTAADTSAYFCVSSRITTFGVVTHYGMDVWGRGTTVTVSS

SEQ ID NO: 3670 - protein, 125 aa, Artificial Sequence
  Description of Artificial Sequence: Synthetic polypeptide
QVQLQQSGGGLVKPGGSLRLSCTASGFIFSDYYMSWIRQAPGKGLEWVSYMKNSDGSKYYADSVKGRFTISRDNAKNSLYLQMNSLRAGDTAVYYCVRDLDYYDRSGYHRWFDPWGQGTLVTVSS

SEQ ID NO: 3671 - protein, 139 aa, Artificial Sequence
  Description of Artificial Sequence: Synthetic polypeptide
PLGYSSLNQGESSYCALSLLSVGKIHMSTWIRCVWLTRGSVQVISRGSGPSKFGTDSKDNSKSQVFLKMNSLQTDDTAMYYCARDYYGNYVWYFDVWGAGTTVTVSSAKTTPPSVYPLAPGCGDTTGSSVTLGCLVKGY

SEQ ID NO: 3672 - protein, 129 aa, Artificial Sequence
  Description of Artificial Sequence: Synthetic polypeptide
FTFTNYYMSWVRQPPGKALEWLGFIINKANGYTTEYSASVKGRFTISRDNSQSILYLQMNTLRAEDSATYYCARAYYGNYPAWFAYWGQGTLVTVSAAKTTAPSVYQLAPVCGDTTGSSVTLGCLVKGY

SEQ ID NO: 3673 - protein, 143 aa, Artificial Sequence
  Description of Artificial Sequence: Synthetic polypeptide
GGLVKPGGSLKLSCAASGFTFSSYAMSWVRQTPEKRLEWVATISSGGSYTYYPDSVKGRFTISRDNAKNTLYLQMSSLRSEDTAMYYCARQGLRRYAMDYWGQGTSVTVSSAKTTPPSVYPLAPGFGDTTGSSVTLGCLVKGY

SEQ ID NO: 3674 - protein, 142 aa, Artificial Sequence
  Description of Artificial Sequence: Synthetic polypeptide
GGLVKPAGSLKLSCAASGFTFSSYAMSWVRQTPEKRLEWVATISSGGSYTYYPDSVKGRFTISIDNAKNTLYLQMSSLRSEDTAMYYCARQGLRRVAMDYWGQGTSVTVSSAKTTAPSVYQLAPGFGDTTGSSVTLGCLVKG

SEQ ID NO: 3675 - protein, 141 aa, Artificial Sequence
  Description of Artificial Sequence: Synthetic polypeptide
GGLVKPWRSLKFSCAASGFTFSSYAMPWVRQTPEKRLEWVATIRSGGSYTYYPDSVKGRFTISRDNAKNTLYLQMSSLRSEDTAMYYCPIYDGHAMDYWGQGTSVTVSSATTTAPSVYPLVPGCADTTGSSVTLGCLVKGY

SEQ ID NO: 3676 - protein, 141 aa, Artificial Sequence; identical to SEQ ID NO: 3675
  Description of Artificial Sequence: Synthetic polypeptide

SEQ ID NO: 3677 - protein, 145 aa, Artificial Sequence
  Description of Artificial Sequence: Synthetic polypeptide
GADSLGVFKTPFGSGSSYLGKMLSSWCVARQTPDKRLEWVATISSGGSYTYYPDSVKGRFTISRDNAKNTLYLQMSSLKSEDTAMYYCARRGITTAIYAMDYWGQGTSVTVSSESQSFPNVFPLVSCESPLSDKNLVAMGCLARD

SEQ ID NO: 3678 - protein, 142 aa, Artificial Sequence
  Description of Artificial Sequence: Synthetic polypeptide
AELARPGPSVKMSCKASGYTFTRYTMHWVKQRPGQGLEWIGYINPSSGYTNYNQKFKDKATLTADKSSRTAYMQLSSLTSEDSAVYYCARVTARYAMDYWGQGTSVTVSSAKTTAPSVYPLAPVCGDTTGSSVTLGCLVKGY

SEQ ID NO: 3679 - protein, 141 aa, Artificial Sequence
  Description of Artificial Sequence: Synthetic polypeptide
ELGASVKLSCKASGYTFTSYWMHWVKLRHGQGLEWIGNIYPGSGSTNYDEKFKDKGTLTVDTSSSTAYMHLSSLTSEDSAVYYCTRKGRGSGYDTMDYWGQGTSVTVSSAKTTAPSVYPLAPVCGDTTGSSVTVGCLVKGY

SEQ ID NO: 3680 - protein, 146 aa, Artificial Sequence
  Description of Artificial Sequence: Synthetic polypeptide
GAELAKPGASVKMSCKASGYTFTSYWMHWVKQRPGQGLEWIGNINPSPGYTEYNQKFKDKGTLTADKSSSTAYMQLSSLTSEDSAVYYCARIGSGYVGYAMDYWGQGTSVTVSSESQSFPNVFPLVSCESPLSEKQLVAMGCLARD

SEQ ID NO: 3681 - protein, 121 aa, Artificial Sequence
  Description of Artificial Sequence: Synthetic polypeptide
EGAAARVWGRLGKAWGFPETLVCSLWIHLSADYAMHWVRQAPEKGLEWVSSIIDGGAGTWSPDSVKGRFTISRDNAKNTLYLQMNSLRAEDTAVYYCVRGVSGSYYVDHEYWGQGTLVTVS

SEQ ID NO: 3682 - protein, 121 aa, Artificial Sequence
  Description of Artificial Sequence: Synthetic polypeptide
EVQLLESGAEVKKPGSSVKVSCKVSGGTFSSFGISWVRQAPGQGLEWMGLIIPILGTANYAQKFQGRLTITADESTSTVYMELSSLRSEDTAVYYCATDPYHNWGEWDLDYWGQGTLVTVS

SEQ ID NO: 3683 - protein, 129 aa, Artificial Sequence
  Description of Artificial Sequence: Synthetic polypeptide
EVQLLEESGGGLVKPGGSLRLSCAASGFTFSNYSMNWVRQAPGKGLEWVGFIRTKAKGGTTEYAASVKGRFTISRDDSKSIAYLQMNSLKTEDTAVYYCTPAGIIIRLVTPIYYYYMDVWGKGTTVTVS

SEQ ID NO: 3684 - protein, 123 aa, Artificial Sequence
  Description of Artificial Sequence: Synthetic polypeptide
EVQLLEESGGGVVQPGRSLRLSCTASGFTFSNYGMQWVRQAPGKRLEWVAFISYSGSNKQYADSVRGRFTISRDNSKNILYLQMNSLRSEDTAVYYCARDSHYLDYLPDAFDYWGQGTVVTVS

SEQ ID NO: 3685 - protein, 126 aa, Artificial Sequence
  Description of Artificial Sequence: Synthetic polypeptide
AEVQLLESGGGLVKPGGSLRLSCAASGFTFSSYAMHWVRQTPEKGLEWVSTISSIGGSTWYSDSVKGRFTISRDNSKNTLFLHMKSLRAEDTAVYYCARDFFSQVGWSTPNNWFDPWGQGTLVTVS

SEQ ID NO: 3686 - protein, 121 aa, Artificial Sequence
  Description of Artificial Sequence: Synthetic polypeptide
AEVQLLESGGGLVKPGGSLRLTCAASGFTFSSYAMHWVRQAPEKGLEWVSSISGSGGGTWYADSVKGRFTISRDNSRNTLYLQLNSLRAEDTAVYYCARPKYTGYENPFDYWGQGTLVTVS

SEQ ID NO: 3687 - protein, 449 aa, Artificial Sequence
  Description of Artificial Sequence: Synthetic polypeptide
QVQLQQSGPELKKPGASVKVSCKDSGYAFSSSWMNWVRQAPGQGLEWIGRIYPGDGDTNYNGKFQGRVTITADKSSSTAYMELSSLRSEDTAVYFCARSGLLRYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3688 - protein, 162 aa, Artificial Sequence
  Description of Artificial Sequence: Synthetic polypeptide
SRAIQLTSPSTLSASVGDRVTITCRASQSIGGWLAWYQQKPGKAPNLLIYKASSLESGVPSRFSGSGSGTEFTLTISSLQPDDFATYHCQQYSGNWTFGQGTKVEIKRTVAAPSVFIFPPSDEQLKSGTASVVCLLNNFYPREAKVQWKVDNALQSGNSQES

SEQ ID NO: 3689 - protein, 163 aa, Artificial Sequence
  Description of Artificial Sequence: Synthetic polypeptide
SRDIQMTQSPSSLSASVGDRVTLTCRASQGVRNALVWYQKPGKAPERLIYAASILQSGVPSRFSGSGSGTEFTLTIGGLQPEDFATYYCLQHNSYPWTFGQGTKVEIKRTVAAPSVFIFPPSDEQLKSGTASVVCLLNNFYPREAKVQWKVDNALQSGNSQES

SEQ ID NO: 3690 - protein, 164 aa, Artificial Sequence
  Description of Artificial Sequence: Synthetic polypeptide
SRDIQMTQSPSSLSASVGDRVTITCQASQDISNYLNWYQQKPGKAPKLLIYDASNLETGVPSRFSGSGSGTDFTFTISSLQPEDIATYYCQQYDNLGVTFGPGTKVDIKRTVAAPSVFIFPPSDEQLKSGTASVVCLLNNFYPREAKVQWKVDNALQSGNSQES

SEQ ID NO: 3691 - protein, 166 aa, Artificial Sequence
  Description of Artificial Sequence: Synthetic polypeptide
SRVIWMTQSPSSLSASVGDRVTITCQASQDITNYLNWYQQKPGKAPNLVIYDTSNLATGVPSRFSGAGSGTDFTFTISSLQPEDIGTYYCQSYDKFPPVFNFGPGTTVDIKRTVAAPSVFIFPPSDEQLKSGTASVVCLLNNFYPREAKVQWKVDNALQSGNSQES

SEQ ID NO: 3692 - protein, 164 aa, Artificial Sequence
  Description of Artificial Sequence: Synthetic polypeptide
SRDIQLTQSPSSLSASVGDRVTITCRASSISSYLNWYQQKPGKAPKLLIYAASNLQSGVPSRFSGSGSGTDFTLTISSLQPEDFATYYCQLSYSALGFTFGPGTTVDIKRTVAAPSVFIFPPSDEQLKSGTASVVCLLNNFYPREAKVQWKVDNALQSGNSQES

SEQ ID NO: 3693 - protein, 164 aa, Artificial Sequence
  Description of Artificial Sequence: Synthetic polypeptide
SRDIQLAQSPSSLSASVGDRVTITCQASQGISNFLNWYQQRPGKAPKLLIYDASSLETGVPSRFSGSGSGTDFTFTISSLQPEDFATYYCQQYDDLPLTFGGGTKVEIRGTVAAPSVFIFPPSDEQLKSGTASVVCLLNNFYPREAKVQWKVDNALQSGNSQES

SEQ ID NO: 3694 - protein, 165 aa, Artificial Sequence
  Description of Artificial Sequence: Synthetic polypeptide
SREIVMTQSPDTLSVSPGERATLSCRASQSVSSNLAWFQQRPGQAPRLLIYGASTRATGVPARFSGSGSGTEFTLTISSLQSEDFAVYYCQQYDNWPPWTFGQGTKVEVKRTVAAPSVFIFPPSDEQLKSGTASVVCLLNNFYPREAKVQWKVDNALQSGNSQES

SEQ ID NO: 3695 - protein, 165 aa, Artificial Sequence
  Description of Artificial Sequence: Synthetic polypeptide
SRDIVMTQSPDSLAVSLGERATINCKSSRSILFSSNNKNFLAWQQRPGQPPKLLVSWASTRESGVPDRFSGSGSGTDFTLTIDSLQAEDVAVYYCQQYYSTPHTFGQGTKLEIKGTVAAPSVFIFPPSDEQLKSGTASVVCLLNNFYPREAKVQWKVDNALQSGN

SEQ ID NO: 3696 - protein, 114 aa, Artificial Sequence
  Description of Artificial Sequence: Synthetic polypeptide
SREIVMTQSPDTLSVSPGERATLSCRASQSVSSNLAWFQQRPGQAPRLLIYGASTRATGVPARFSGSGSGTEFTLTISSLQSEDFAVYYCQQYDNWPPWTFGQGTKVEVKRTVA

SEQ ID NO: 3697 - protein, 113 aa, Artificial Sequence
  Description of Artificial Sequence: Synthetic polypeptide
SREIVLTQSPATLSVSPGERATLSCRASQSVRTNVAWYQHKPGQAPRLLIYAASTRATDIPARFSGSGSGTEFTLTLSSLQSEDFALYFCQHYDSWPVTFGQGTRLEIKRTVA

SEQ ID NO: 3698 - protein, 109 aa, Artificial Sequence
  Description of Artificial Sequence: Synthetic polypeptide
  MOD_RES (5)..(5): Any amino acid
  MOD_RES (15)..(15): Any amino acid
  MOD_RES (17)..(17): Any amino acid
  MOD_RES (26)..(26): Any amino acid
  MOD_RES (33)..(34): Any amino acid
  MOD_RES (65)..(65): Any amino acid
  MOD_RES (87)..(87): Any amino acid
  MOD_RES (96)..(97): Any amino acid
  MOD_RES (99)..(99): Any amino acid
SRDIXMTQSPSTLSXSXGERATLSCXASQSVSXXLAWYQQKPGQAPRLLIYGASTRATGIPSRFXGSGSGTEFTLTISSLQSEDFAXYYCQQYKKXXPXTFGQGTKLEI

SEQ ID NO: 3699 - protein, 112 aa, Artificial Sequence
  Description of Artificial Sequence: Synthetic polypeptide
SRAIQLTQSPSTLSASVGDRVTITCRASQSIGGWLAWYQQKPGKAPNLLIYKASSLESGVPSRFSGSGSGTEFTLTISSLQPDDFATYHCQQYSGNWTFGQGTKVEIKRTVA

SEQ ID NO: 3700 - protein, 106 aa, Artificial Sequence
  Description of Artificial Sequence: Synthetic polypeptide
TQSPSSLSASVGDRVTITCRASQSIGGWLAWYQQKPGKAPNLLIYKASSLESGVPSRFSGSGSGTEFTLTISSLQPDDFATYHCQQYSGNWTFGQGTKVEIKRTVA

SEQ ID NO: 3701 - protein, 113 aa, Artificial Sequence
  Description of Artificial Sequence: Synthetic polypeptide
SRDIQMTQSPSTLSASVGDRVTITCRASQDITRYLAWYQQKPGKAPKLLIYRASILESGVSSRFSGSGSGTEFTLTISSLQPDDFATYYCQQFNDYPATFGQGTKVEIKRTVA

SEQ ID NO: 3702 - protein, 113 aa, Artificial Sequence
  Description of Artificial Sequence: Synthetic polypeptide
SRDIQMTQSPSTLSASVGDRVTITCRASQDITRYLAWHQQKPGKAPKLLIYRASILESGVSSRFSGSGSGTEFTLTISSLQPDDFATYYCRQFNDYPATFGQGTKVEIKRTVA

SEQ ID NO: 3703 - protein, 113 aa, Artificial Sequence
  Description of Artificial Sequence: Synthetic polypeptide
SRDIQLTQSPSTLSASVGDRVTITCRASQDITRYLAWYQQKPGKAPKLLIYRASILESGVSSRFSGSGSGTEFTLTISSLQPDDFATYYCQQFNDYPATFGQGTKVEIKRTVA

SEQ ID NO: 3704 - protein, 113 aa, Artificial Sequence
  Description of Artificial Sequence: Synthetic polypeptide
SRDIQMTQSPSSLSASVGDRVTLTCRASQGVRNALVWYQQKPGKAPERLIYAASILQSGVPSRFSGSGSGTEFTLTIGGLQPEDFATYYCLQHNSYPWTFGQGTKVEIKRTVA

SEQ ID NO: 3705 - protein, 113 aa, Artificial Sequence
  Description of Artificial Sequence: Synthetic polypeptide
SRDIQLTQSPSSVSASVGDRVTITCRASQDISTWLAWYQQKAGKAPRLLIYAASSLQSGVPSRFSGSGSGTEFSLTITNLQPEDFATYYCQQANAVPPAFGGGTKVEMNRTVA

SEQ ID NO: 3706 - protein, 113 aa, Artificial Sequence
  Description of Artificial Sequence: Synthetic polypeptide
SRDIQMTQSPSSLSASVGDRVTITCQASQDISNYLNWYQQKPGKAPKLLIYDASNLETGVPSRFSGSGSGTDFTFTISSLQPEDIATYYCQQYDNLGVTFGPGTKVDIKRTVA

SEQ ID NO: 3707 - protein, 115 aa, Artificial Sequence
  Description of Artificial Sequence: Synthetic polypeptide
SRVIWMTQSPSSLSASVGDRVTITCQASQDITNYLNWYQQKPGKAPNLVIYDTSNLATGVPSRFSGAGSGTDFTFTISSLQPEDIGTYYCQSYDKFPPVFNFGPGTTVDIKRTVA

SEQ ID NO: 3708 - protein, 112 aa, Artificial Sequence
  Description of Artificial Sequence: Synthetic polypeptide
SRDIQLTQSPSSLSASVGDRVTITCQASQDIANYLNWYQQKPGKAPKLLIYDVSNLEPGVPSRFSGSGSGTDFTFTINSLQPEDVATYYCQQYHNLITFGQGTRLEIKRTVA

SEQ ID NO: 3709 - protein, 113 aa, Artificial Sequence
  Description of Artificial Sequence: Synthetic polypeptide
SRAIQMTQSPSSLSASVGDRVTITCQASQDINNHLNWYQHKPGKAPKVLIYDVSNLETGVPSRFSGSGSGTDFTLSISSLQPEDVATYFCHQYESVRPTFGQGTKLEIKRTVA

SEQ ID NO: 3710 - protein, 113 aa, Artificial Sequence
  Description of Artificial Sequence: Synthetic polypeptide
SRDIQLAQSPSSLSASVGDRVTITCQASQGISNFLNWYQQRPGKAPKLLIYDASSLETGVPSRFSGSGSGTDFTFTISSLQPEDFATYYCQQYDDLPLTFGGGTKVEIRGTVA

SEQ ID NO: 3711 - protein, 114 aa, Artificial Sequence
  Description of Artificial Sequence: Synthetic polypeptide
SRDIQLTQSPSSLSASVGDRVTITCRASQSISSYLNWYQQKPGKAPKLLIYAASNLQSGVPSRFSGSGSGTDFTLTISSLQPEDFATYYCQLSYSALGFTFGPGTTVDIKRTVA

SEQ ID NO: 3712 - protein, 113 aa, Artificial Sequence
  Description of Artificial Sequence: Synthetic polypeptide
SRAIQMTQSPSSLSASVGDRVTITCRASQSISNYLNWYQQKPGKAPSLLIYAASRLQSGVPSRFSGSGSGTDFTLTISSLQPEDFATYYCQQSSRTSLTFGGGTKVEIKRTVA

SEQ ID NO: 3713 - protein, 113 aa, Artificial Sequence
  Description of Artificial Sequence: Synthetic polypeptide
SRDIQMTQSPSSLSASVGDTVTITCRASQTISGSLNWYQQKPGKAPKLLIYGASTLYSGVPSRFSGGASGTDFTLTIRSLQPEDFATYYCQQSSSNTVTFGPGTKVDIKRTVA

SEQ ID NO: 3714 - protein, 113 aa, Artificial Sequence
  Description of Artificial Sequence: Synthetic polypeptide
SRDIQMTQSPSSLSASVGDRVTITCRASQGISNYLNWYQQKPGRAPNLLIYGASTLLRGVPARFSGSGSGTDFTLNISNLQPEDFATYYCQQSDSIPMTFGQGTRLDIKRTVA

SEQ ID NO: 3715 - protein, 113 aa, Artificial Sequence
  Description of Artificial Sequence: Synthetic polypeptide
SRDIVMTQSPSSLSASVGDRVTITCRASQDIRNYLNWYQYRPGRAPNLLIYGASTLYRGAPARFTGSGSGTDFTLNITNLQPEDFATYYCQQSDSTPMTFGQGTRLDIERTVA

SEQ ID NO: 3716 - protein, 113 aa, Artificial Sequence
  Description of Artificial Sequence: Synthetic polypeptide
SRDIQMTQSPSSLSTSVGDRVTITCRASQDITKNLNWYQQKPGRAPNLLIYGASTLLRGVPARFSGSGSGTDFTLSISSLQPEDFATYYCQQSDSTPMTFGQGTRLDIKRTVA

SEQ ID NO: 3717 - protein, 113 aa, Artificial Sequence
  Description of Artificial Sequence: Synthetic polypeptide
MTQSPLSLPVTPGEPASISCRSSQSLLHSNGYNYLDWYLQKPGQSPQLLIYMGSSRASGVPDRFSGSGSGTDFTLKISRVEAEDVGVYYCMQPLQTPYTFGQGTKLEIKRTVA

SEQ ID NO: 3718 - protein, 104 aa, Artificial Sequence
  Description of Artificial Sequence: Synthetic polypeptide
MTQSPLSLPVTPGEPASISCRSSQSLLHSNGYNYVDWYLQKPGQSPQLLIYMGSSRASGVPDRFSGSGSGSDFTLKISRVEAEDVGVYYCMQPLQTPYTFGQGT

SEQ ID NO: 3719 - protein, 165 aa, Artificial Sequence
  Description of Artificial Sequence: Synthetic polypeptide
SRSYVLTQPPSASGTPGQRVTISCSGTSSNIGRNRVNWYQQLPGTAPKLLIYSNNQRPSGVLDRFSGSKSGTSASLAISGLQSEDEGDYYCAAWDDSLHGGVFGGGTQLTVLGSKAAPSVTLFPPSSEELQANKATLVCLVSDFYPGALTVAWKADSSPVKAGVE

SEQ ID NO: 3720 - protein, 166 aa, Artificial Sequence
  Description of Artificial Sequence: Synthetic polypeptide
SRQSVLTQPPSASGTPGQRVTISCSGSSSNIGSNTVNWYQQLPGTAPKLLIYNNIERPSGVPDRFSGSKSGTSASLAISGLQSEDEADYYCATWDDSLNGVVFGGGTQLTVLGQPKAAPSVTLFPPSSEELQANKATLVCLVSDFYPGALTVAWKADSSPVKAGVE

SEQ ID NO: 3721 - protein, 165 aa, Artificial Sequence
  Description of Artificial Sequence: Synthetic polypeptide
SRSVLTQPPSTSGTPGQSVTISCSGSSSNIGSNTVNWYRHLPGTAPKLLIYGDNLRPSGVSDRFSGSKSGTSASLAISGLQSDDEADYYCATWDETLNGVIYGGGTKLTALGQPKAAPSVTLFPPSSEELQANKATLVCLISDFYPGALTVAWKADSSPVKAGVE

SEQ ID NO: 3722 - protein, 166 aa, Artificial Sequence
  Description of Artificial Sequence: Synthetic polypeptide
SRQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSTFGGGTKLTVLGQPKTAPSVTLFPPSSEELQANKATLVCLISDFYPGALTVAWKADSSPVKAGV

SEQ ID NO: 3723 - protein, 166 aa, Artificial Sequence
  Description of Artificial Sequence: Synthetic polypeptide
SRQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGLVFGGGTRLTALGQPKAAPSVTLFPPSSEELQANKATLVCLISDFYPGALTVAWKADSSPVKAGV

SEQ ID NO: 3724 - protein, 166 aa, Artificial Sequence
  Description of Artificial Sequence: Synthetic polypeptide
  MOD_RES (12)..(12): Any amino acid
SRQSVLTQPPSXSGAPGQRVTISCTGSDSNIGSGYHVHWYQHLPGKGPKLLIANNDNRPSGVPDRFSGSKSEFSAFLAITGLHPEDEGDYYCQSYDNTLPGSLFGGGTRLTVLGQPKAAPSVTLFPPSSEELQANKATLVCLISDFYPGALTVAWKADSSPVKAGV

SEQ ID NO: 3725 - protein, 165 aa, Artificial Sequence
  Description of Artificial Sequence: Synthetic polypeptide
SRQSVLTQPASVSGSPGSITISCTGTRNDVGSYNLVSWYQQFPGKAPKLIIYADNQRPSGEYNRFSGSKSGNTASLTISGLRAEDEADYFCCSYSLTNDVIFGGGTRLTVLGQPKAAPSVTLFPPSSEELQANKATLVCLISDFYPGALTVAWKADSSPVKAGVE

SEQ ID NO: 3726 - protein, 165 aa, Artificial Sequence
  Description of Artificial Sequence: Synthetic polypeptide
SRQSVLTPASVSGSPGQSITISCTGTSSDVGSYKLVSWYQQHPDKAPKLIIYEINQRPSGVSDRFSASKSGNTASLTISGLQAEDEADYYCCSYTDIPSLIFGGGTKLTVLGQPKAAPSVTLFPPSSEELQANKATLVCLISDFYPGALTVAWKADSSPVKAGVE

SEQ ID NO: 3727 - protein, 166 aa, Artificial Sequence
  Description of Artificial Sequence: Synthetic polypeptide
SRQSALTQPASVSGSPGQSITISCTGTSSDVGAYNYVSWYHHHPGKAPKLMIYDVYRRPSWVSSRFSGSKSGNTASLTISGLQPEDEGDYYCISYTTRDTLLFGGGTKVTVLGQPKAAPSVTLFPPSSEELQANKATLVCLISDFYPGALTVAWKADSSPVKAGVE

SEQ ID NO: 3728 - protein, 166 aa, Artificial Sequence
  Description of Artificial Sequence: Synthetic polypeptide
SRQSALTQPPSASGSPGQSVTISCAGTSSDVGGYNHVSQYQQYPGKAPKLMISDVNKRPSGVSNRFSGSKSGNTASLTISGLQAEDEADYYCSSYTNTNTLVFGGGTKLTVLGQPKAAPSVTLFPPSSEELQANKATLVCLISDFYPGALTVAWKADSSPVKAGVE

SEQ ID NO: 3729 - protein, 166 aa, Artificial Sequence
  Description of Artificial Sequence: Synthetic polypeptide
SRNFMLTQPHSVSQSPGKTVIISCTRSSGSIVGNYVQWYQQRPGSSPTTLIYKGNQRPSGVPDRFSGSIDSSSNSASLTISGLETEDEADYYCQSYDSSYQVFGGGTKLTVLGQPKAAPSVTLFPPSSEELQANKATLVCLISDFYPGALTVAWKADSSPVKAGVE

SEQ ID NO: 3730 - protein, 165 aa, Artificial Sequence
  Description of Artificial Sequence: Synthetic polypeptide
SRQAVLTPSSLSASPGASASLTCTLRSGFYVGSYMINWYQQKPGSPPQFLLRYRSDSDIQRGSGVPSRFSGSKDTSANAGILLISGLQPEDEADYYCMIWHIDTVFFGGGSKLTVLGQSKAAPSVTLFPPSSEELQANKATLVCLISDFYPGALTVAWKADSSPV

SEQ ID NO: 3731 - protein, 162 aa, Artificial Sequence
  Description of Artificial Sequence: Synthetic polypeptide
SRQSALTQPSSVSGSPGQSITISCTGTSSDVGGYNYVSWYQQHPGKAPKLMIYEVSNRPSGVPNRFSGSKSGNTASLTISGLQAEDEADYYCSSYTSSSTNWVFGGGTKLTVLGQPKAAPSVTLFPPSSEELQANKATLVCLISDFYPGALTVAWKADSSPV

SEQ ID NO: 3732 - protein, 161 aa, Artificial Sequence
  Description of Artificial Sequence: Synthetic polypeptide
SRQSALTQPASVSGSPGQSITISCTGTSSDVGAYNYVSWYHHHPGKAPKLMIYDVYRRPSWVSSRFSGSKSGNTASLTISGLQPEDEGDYYCISYTTRDTLLFGGGTKVTVLGQPKAAPSVTLFPPSSEELQANKATLVCLISDFYPGALTVAWKADSSPV

SEQ ID NO: 3733 - protein, 161 aa, Artificial Sequence
  Description of Artificial Sequence: Synthetic polypeptide
SRQSVLTQPASVSGSPGQSITISCTGTSSDVGSYKLVSWYQQHPDKAPKLIIYEINQRPSGVSDRFSASKSGNTASLTISGLQAEDEADYYCCSYTDIPSLIFGGGTKLTVLGQPKAAPSVTLFPPSSEELQANKATLVCLISDFYPGALTVAWKADSSPV

SEQ ID NO: 3734 - protein, 161 aa, Artificial Sequence
  Description of Artificial Sequence: Synthetic polypeptide
SRQSVLTQPASVSGSPGQSITISCTGTRNDVGSYNLVSWYQQFPGKAPKLIIYADNQRPSGEYNRFSGSKSGNTASLTISGLRAEDEADYFCCSYSLTNDVIFGGGTRLTVLGQPKAAPSVTLFPPSSEELQANKATLVCLISDFYPGALTVAWKADSSPV

SEQ ID NO: 3735 - protein, 162 aa, Artificial Sequence
  Description of Artificial Sequence: Synthetic polypeptide
SRQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGLVFGGGTRLTALGQPKAAPSVTLFPPSSEELQANKATLVCLISDFYPGALTVAWKADSSPV

SEQ ID NO: 3736 - protein, 162 aa, Artificial Sequence
  Description of Artificial Sequence: Synthetic polypeptide
SRQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSTFGGGTKLTVLGQPKTAPSVTLFPPSSEELQANKATLVCLISDFYPGALTVAWKADSSPV

SEQ ID NO: 3737 - protein, 162 aa, Artificial Sequence
  Description of Artificial Sequence: Synthetic polypeptide
  MOD_RES (12)..(12): Any amino acid
SRQSVLTQPPSXSGAPGQRVTISCTGSDSNIGSGYHVHWYQHLPGKGPKLLIANNDNRPSGVPDRFSGSKSEFSAFLAITGLHPEDEGDYYCQSYDNTLPGSLFGGGTRLTVLGQPKAAPSVTLFPPSSEELQANKATLVCLISDFYPGALTVAWKADSSPV

SEQ ID NO: 3738 - protein, 161 aa, Artificial Sequence
  Description of Artificial Sequence: Synthetic polypeptide
SRQSVLTQPPSASGTPGQRVTISCSGSSSNIGSNTVNWYQQLPGTAPKLLIYNNIERPSGVPDRFSGSKSGTSASLAISGLQSEDEADYYCATWDDSLNGVVFGGGTQLTVLGQPKAAPSVTLFPPSSEELQANKATLVCLVSDFYPGALTVAWKADSSPV

SEQ ID NO: 3739 - protein, 116 aa, Artificial Sequence
  Description of Artificial Sequence: Synthetic polypeptide
SRQSVLTQPPSASGTPGQRVTISCSGSSSNIGSNTVNWYQQLPGTAPKLLIYNNIERPSGVPDRFSGSKSGTSASLAISGLQSEDEADYYCATWDDSLNGVVFGGGTQLTVLGQPK

SEQ ID NO: 3740 - protein, 151 aa, Artificial Sequence
  Description of Artificial Sequence: Synthetic polypeptide
SASGTPGQRVTISCSGSSSNIGSNTVNWYQQLPGTAPKLLIYNNIERPSGVPDRFSGSKSGTSASLAISGLQSEDEADYYCATWDDSLNGVVFGGGTQLTVLGQPKAAPSVTLFPPSSEELQANKATLVCLVSDFYPGALTVAWKADSSPV

SEQ ID NO: 3741 - protein, 161 aa, Artificial Sequence
  Description of Artificial Sequence: Synthetic polypeptide
SRSYVLTQPPSASGTPGQRVTISCSGTSSNIGRNRVNWYQQLPGTAPKLLIYSNNQRPSGVLDRFSGSKSGTSASLAISGLQSEDEGDYYCAAWDDSLHGGVFGGGTQLTVLGQSKAAPSVTLFPPSSEELQANKATLVCLVSDFYPGALTVAWKADSSPV

SEQ ID NO: 3742 - protein, 162 aa, Artificial Sequence
  Description of Artificial Sequence: Synthetic polypeptide
SRQYVLTQPPSVSGTPGQRVTISCSGSSSNIGTNSVTWYQRLPGTAPKLLIYGSHQRPSGVPDRFSGSKSGTSASLAITGLQSGDEADYFCVVWDDNLNGAVLFGGGTKLTVLGQPKAAPSVTLFPPSSEELQANKATLVCLISDFYPGALTVAWKADSSPV

SEQ ID NO: 3743 - protein, 161 aa, Artificial Sequence
  Description of Artificial Sequence: Synthetic polypeptide
SRQSVLTQPPSTSGTPGQSVTISCSGSSSNIGSNTVNWYRHLPGTAPKLLIYGDNLRPSGVSDRFSGSKSGTSASLAISGLQSDDEADYYCATWDETLNGVIYGGGTKLTALGQPKAAPSVTLFPPSSEELQANKATLVCLISDFYPGALTVAWKADSSPV

SEQ ID NO: 3744 - protein, 157 aa, Artificial Sequence
  Description of Artificial Sequence: Synthetic polypeptide
SRSYVLTQPPSESVAPGQTARISCGGSNIGSYGVHWYQQKAGQAPVLVVHDDSDRPSGIPERFSGSNSGNTATLTISSVEAGDEADYYCQVWDNSAVIFGGGTKLTVLSQPKAAPSVTLFPPSSEELQANKATLVCLISDFYPGALTVAWKADSSPV

SEQ ID NO: 3745 - protein, 161 aa, Artificial Sequence
  Description of Artificial Sequence: Synthetic polypeptide
SRNFMLTQPHSVSQSPGKTVIISCTRSSGSIVGNYVQWYQQRPGSSPTTLIYKGNQRPSGVPDRFSGSIDSSSNSASLTISGLETEDEADYYCQSYDSSYQVFGGGTKLTVLGQPKAAPSVTLFPPSSEELQANKATLVCLISDFYPGALTVAWKADSSPV

SEQ ID NO: 3746 - protein, 166 aa, Artificial Sequence
  Description of Artificial Sequence: Synthetic polypeptide
SRQAVLTQPSSLSASPGASASLTCTLRSGFYVGSYMINWYQQKPGSPPQFLLRYRSDSDIQRGSGVPSRFSGSKDTSANAGILLISGLQPEDEADYYCMIWHIDTVFFGGGSKLTVLGQSKAAPSVTLFPPSSEELQANKATLVCLISDFYPGALTVAWKADSSPV

SEQ ID NO: 3747 - protein, 449 aa, Artificial Sequence; identical to SEQ ID NO: 3642
  Description of Artificial Sequence: Synthetic polypeptide

SEQ ID NO: 3748 - protein, 235 aa, Artificial Sequence
  Description of Artificial Sequence: Synthetic polypeptide
MEAPAQLLFLLLLWLPDTTGEIVLTQSPGTLSLSPGERATLSCRASQSVSYSSLAWYQQKPGQAPSLLIYGASSRATGIPDRFSGSGSGPDFTLTISRLEPEDFAVYYCQHYGNSPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3749 - protein, 233 aa, Artificial Sequence
  Description of Artificial Sequence: Synthetic polypeptide
MLPSQLIGFLLLWVPASRGEIVLTQSPDFQSVSPKEKVTITCRASQSVGSSLHWYQQKPDQSPKLLIKYASQSFSGVPSRFSGSGSGTDFTLTINSLETEDAATYYCHQSSSLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3750 - protein, 224 aa, Artificial Sequence
  Description of Artificial Sequence: Synthetic polypeptide
EAGQVMTQTPLSLPVTLGQSASISCRSSQSLVSSDGKTYLNWFHQRPGQSPRRLIYKVSKRDSGVPDRFSGSGSGTDFTLKISRVEAEDVGVYFCMQATHWLWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECAAA

SEQ ID NO: 3751 - protein, 219 aa, Artificial Sequence
  Description of Artificial Sequence: Synthetic polypeptide
EAGQQMTQSPSSLSASVGDRVTITCRASQSIARYLNWYQQRPGKAPKVLIYDASSLHTGVPSRFSGSGSGTDFTLTISSLRPEDFATYYCQQTYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECAAA

SEQ ID NO: 3752 - protein, 218 aa, Artificial Sequence
  Description of Artificial Sequence: Synthetic polypeptide
EAGQQLTQSPSSLSASEGDRVTITCRASQSISNWLAWYQQKPGKAPKLLIYKASSLESGVPSRFSGSGSGTEFTLTISSLQPDDFATYYCQQYSGSATFGQGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGECAAA

SEQ ID NO: 3753 - protein, 219 aa, Artificial Sequence
  Description of Artificial Sequence: Synthetic polypeptide
EAGQQLTQSPSSLSASVGDRVTITCRASQGISRYLAWYQQKPGKAPKLLIYAASTLQSGVPSRFSGSGSGTDFTLTISSLQPEDFATYYCQQLNSYPLTFGGGTRVEVKRTVAAPSVFIFPPSDEQLKSGTASVACLLNNFYPREAKVQWKVDNALQSGNSQESVTEQDSKDSTYSLSSTLTLSKADYEKHKVYACEVTHQGLSSPVTKSFNRGECAAA

SEQ ID NO: 3754 - protein, 215 aa, Artificial Sequence
  Description of Artificial Sequence: Synthetic polypeptide
EAGQVLTQSPATLSVSPGERATLSCRASQSVGSNLAWYQQKPGQAPRLLIYGASTRATGIPARFSGSGSGTEFTLTISSLQSEDFAVYYCQQGWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGECAAA

SEQ ID NO: 3755 - protein, 215 aa, Artificial Sequence
  Description of Artificial Sequence: Synthetic polypeptide
EAGQSVLTQPPSVSVSPGQTASITCSGNKLGNKYACWYQQKPGQSPILIIYQDKKRPSGIPERFSGSNSGNTATLTISGTQAMDEADYYCQAWDSDTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 3756 - protein, 107 aa, Artificial Sequence
  Description of Artificial Sequence: Synthetic polypeptide
DIQMTQSPSSVSASVGDRVTITCRASQGISSWLAWYQQKPGKAPKLLIYKASSLQSGVPSRFSGSGSGTDFTLTISSLQPEDFATYYCQQYSTSPITFGGGTKVEIK

SEQ ID NO: 3757 - protein, 214 aa, Artificial Sequence
  Description of Artificial Sequence: Synthetic polypeptide
DIQMTQSPSSLSASVGDRVTITCRASQDIRNYLNWYQQKPGKAVKLLIYYTSRLLPGVPSRFSGSGSGTDYSLTISSQEQEDIGTYFCQQGNTLPWTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 3758 - protein, 113 aa, Artificial Sequence
  Description of Artificial Sequence: Synthetic polypeptide
EIVMTQSPLSLPVTPGEPASISCRSSQSLLHSNRYNYLDWYLQKPGQSPQLLIYLGSNRASGVPDRFSGSGSGTDFTLKISRVEAEDVGVYYCMQALQTPFTFGPGTKVEIKR

SEQ ID NO: 3759 - protein, 113 aa, Artificial Sequence
  Description of Artificial Sequence: Synthetic polypeptide
EIVMTQSPLSLPVTPGEPASISCRSSQSLLHSNTYNYLDWYLQKPGQSPQLLIYLGSNRASGVPGRFSGSGSGTDFTLKISRVEAEDIGVYYCMQALQTPLTFGQGTKVKIKA

SEQ ID NO: 3760 - protein, 113 aa, Artificial Sequence
  Description of Artificial Sequence: Synthetic polypeptide
DIVMTQSPLSLSVTPGQPASISCKSSQSLLHSDGNTYLYWYLQKPGQSPQLLIYRVSNRASGVPDRFSGSGSGTDFTLKISQVEAEDVGVYYCMQGIQLPLTFGGGTKVEIKA

SEQ ID NO: 3761 - protein, 108 aa, Artificial Sequence
  Description of Artificial Sequence: Synthetic polypeptide
DILMTQSPSSLSASVGDRVTITCRASQGISNYLAWYQQKPGKAPKLLIYYASKLESGVPSRFSGSGSGPDYTLTISSLQPEDSATYFCQQYSTNPLSFGGGTKLEIKA

SEQ ID NO: 3762 - protein, 108 aa, Artificial Sequence
  Description of Artificial Sequence: Synthetic polypeptide
DIRLTQSPSSLSASVGDRVTITCRASQGISTWLAWYQQKPGRAPKPLIYAASNLQSGVPSRFSGSGSGTEFTLTISSLQPEDFATYYCQQYNSYPITFGQGTRLEIKR

SEQ ID NO: 3763 - protein, 108 aa, Artificial Sequence
  Description of Artificial Sequence: Synthetic polypeptide
DIVLTQSPSSLSASLGDRVTITCWASQGITTRLNWYQHKPGKPPKLLIYDASRLGSGVPSHFSGSGSGTDFTLTINSLQPEDFATYFCQQFKMYPPTFGQGTKVDIKA

SEQ ID NO: 3764 - protein, 110 aa, Artificial Sequence
  Description of Artificial Sequence: Synthetic polypeptide
AELQMTQSPSSLSASVGDRVTITCRASQGIRNDLGWYQQKPGKAPKLLIYAASSLQSGVPSRFSGSGSGTDFTLTISSLQPEDFATYYCLQDYTYPWTFGQGTKLEIKRT

SEQ ID NO: 3765 - protein, 121 aa, Artificial Sequence
  Description of Artificial Sequence: Synthetic polypeptide
RVQLLEQSGAEVKKPGESLKISCKGSGYSFTNYWIGWVRQMPGKGLEWMGIIYPDDSDTRYSPSFQGQVTISFDKSINTAYLQWSSLKASDTAIYYCARALWFRDWGKMDVWGKGTTVTVS

SEQ ID NO: 3766 - protein, 110 aa, Artificial Sequence
  Description of Artificial Sequence: Synthetic polypeptide
AELQMTQSPSSLSASVGDRVTITCRASQDIRNYLAWYQQEPGKAPRLLIYYASKLQSGVPSRFSGRGSGTDYSLTISSLQPEDFATYYCQQYDSVPLTFGGGTKMEIKRT

SEQ ID NO: 3767 - protein, 107 aa, Artificial Sequence
  Description of Artificial Sequence: Synthetic polypeptide
AIQLTQSPSSLSAYVGDKVTITCHASQGINSWLAWYQQKPGKAPKLLIYKASSLLSGVPSRFSGSGSGTDYTLTISSLQSEDFASYYCLQYDSAPLAFGPGTKLDIK

SEQ ID NO: 3768 - protein, 119 aa, Artificial Sequence
  Description of Artificial Sequence: Synthetic polypeptide
SGPGLLKPSETLSLTCAVSGDSISSGYYWSWIRQSPGKGLEWIGHIYGSTADTKYNPSLRSRVTISKDTSKNQLSLQLRSVTAADTAVYYCARSGYNFWSGEYYGLDSWGQGAVVTVSS

SEQ ID NO: 3769 - protein, 108 aa, Artificial Sequence
  Description of Artificial Sequence: Synthetic polypeptide
  MOD_RES (1)..(3): Any amino acid
  MOD_RES (16)..(16): Any amino acid
  MOD_RES (19)..(19): Any amino acid
  MOD_RES (28)..(28): Any amino acid
  MOD_RES (30)..(31): Any amino acid
  MOD_RES (35)..(35): Any amino acid
  MOD_RES (45)..(45): Any amino acid
  MOD_RES (48)..(50): Any amino acid
  MOD_RES (58)..(58): Any amino acid
  MOD_RES (69)..(69): Any amino acid
  MOD_RES (76)..(76): Any amino acid
  MOD_RES (78)..(78): Any amino acid
  MOD_RES (88)..(88): Any amino acid
  MOD_RES (90)..(92): Any amino acid
  MOD_RES (95)..(95): Any amino acid
  MOD_RES (99)..(99): Any amino acid
  MOD_RES (103)..(103): Any amino acid
  MOD_RES (106)..(106): Any amino acid
XXXTQSPSSLSASVGXRVXITCRASQDXNXXLAWXQQKPGKAPKXLIXXXSSLQGGVXSRFSGSGSGTXFTLTISXLXPEDFATYYCXQXXXYPXTFGXGTKXEIXRT

SEQ ID NO: 3770 - protein, 108 aa, Artificial Sequence
  Description of Artificial Sequence: Synthetic polypeptide
APMTQSPSSLSASVGDRVSITCRASQDINDFLAWFQQKPGKAPKRLIFRTSSLQGGVSSRFSGSGSGTEFTLTISNLRPEDFATYYCLQHSSYPPTFGQGTKLEISRT

SEQ ID NO: 3771 - protein, 107 aa, Artificial Sequence
  Description of Artificial Sequence: Synthetic polypeptide
ELTQSPSSLSASVGGRVTITCRASQDVNTWLAWYQQKPGKAPKPLIYAASSLQGGVPSRFSGSGSGTDFTLTISSLQPEDFATYYCQQYKHYPLTFGGGTKVEIKRT

SEQ ID NO: 3772 - protein, 132 aa, Artificial Sequence
  Description of Artificial Sequence: Synthetic polypeptide
MFWIPASSSDVLMTQTPLSLPVSLGDQASISCRSSQSIIHSNGDTFLEWFLQKPGQSPKLLIYKVSNRFSGVPDRFSGSGSGTDFTLKISRVEAEDLGVYYCFQGSHVPLTFGAGTKLELKRADAAPTVSKG

SEQ ID NO: 3773 - protein, 124 aa, Artificial Sequence
  Description of Artificial Sequence: Synthetic polypeptide
ELVMTQSPLSLPVSLGDQASISCRSSQSIIHSNGDTFLEWFLQKPGQSPKLLIYKVSNRFSGVPDRFSGSGSGTDFTLKISRVEAEDLGVYYCFQGSHVPLTFGAGTKLELKRADAAPTVKGEF

SEQ ID NO: 3774 - protein, 134 aa, Artificial Sequence; identical to SEQ ID NO: 3650
  Description of Artificial Sequence: Synthetic polypeptide

SEQ ID NO: 3775 - protein, 107 aa, Artificial Sequence
  Description of Artificial Sequence: Synthetic polypeptide
AIQLTQSPSSLSAYVGDKVTITCHASQGINSWLAWYQQKPGKAPKLLIYKASSLQSGVPSRFSGSGSGTDYTLTISSLQSEDFASYYCLQYDSAPLAFGPGTKLDIK

SEQ ID NO: 3776 - protein, 107 aa, Artificial Sequence; identical to SEQ ID NO: 3767
  Description of Artificial Sequence: Synthetic polypeptide

SEQ ID NO: 3777 - protein, 107 aa, Artificial Sequence
  Description of Artificial Sequence: Synthetic polypeptide
AIQLTQSPSSLSAYVGDKVTITCHASQGINSWLAWYQQKPGKAPKLLIYKARSLQSGVPSRFSGSGSGTDYTLTISSLQSEDFASYYCLQYDSAPLAFGPGTKLDIK

SEQ ID NO: 3778 - protein, 107 aa, Artificial Sequence
  Description of Artificial Sequence: Synthetic polypeptide
AIQLTQSPSSLSAYVGDKVTITCRASQGINSWLAWYQQKPGKAPKLLIYKASSLQEGVPSRFSGSGSGTDYTLTISSLQSEDFASYYCLQYDSAPLAFGPGTKLDIK

SEQ ID NO: 3779 - protein, 107 aa, Artificial Sequence
  Description of Artificial Sequence: Synthetic polypeptide
AIQLTQSPSSLSASVGDRVTITCRASQGINSWLAWYQQKPGKAPKLLIYKASSLQSGVPSRFSGSGSGTDFTLTISSLQPEDFATYYCLQYDSAPLAFGPGTKVDIK

SEQ ID NO: 3780 - protein, 107 aa, Artificial Sequence
  Description of Artificial Sequence: Synthetic polypeptide
AIQLTQSPSSLSASVGDRVTITCRASQGINSWLAWYQQKPGKAPKLLIYKASSLLSGVPSRFSGSGSGTDFTLTISSLQPEDFATYYCLQYDSAPLAFGPGTKVDIK

SEQ ID NO: 3781 - protein, 107 aa, Artificial Sequence
  Description of Artificial Sequence: Synthetic polypeptide
AIQLTQSPSSLSASVGDRVTITCRASQGINSWLAWYQQKPGKAPKLLIYKARSLQSGVPSRFSGSGSGTDFTLTISSLQPEDFATYYCLQYDSAPLAFGPGTKVDIK

SEQ ID NO: 3782 - protein, 107 aa, Artificial Sequence
  Description of Artificial Sequence: Synthetic polypeptide
AIQLTQSPSSLSASVGDRVTITCRASQGINSWLAWYQQKPGKAPKLLIYKASSLQEGVPSRFSGSGSGTDFTLTISSLQPEDFATYYCLQYDSAPLAFGPGTKVDIK

SEQ ID NO: 3783 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPTFGGGTKVEIK

SEQ ID NO: 3784 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSMYTFGQGTKLEIK

SEQ ID NO: 3785 - protein, 106 aa, Artificial Sequence
  Description of Artificial Sequence: Synthetic polypeptide
AIQLTQSPSSLSASVGDRVTITCRASQGISSALAWYQQKPGKAPKLLIYDASSLKSGVPSRFSGSGSGTDFTLTISSLQPEDFATYYCQQFNSYWTFGQGTKVEIK

SEQ ID NO: 3786 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTRLEIK

SEQ ID NO: 3787 - protein, 107 aa, Artificial Sequence
  Description of Artificial Sequence: Synthetic polypeptide
DIQMTQSPSSLSASVGDRVTITCRASQGISSWLAWYQQKPEKAPKSLIYAASSLQSGVPSRFSGSGSGTDFTLTISSLQPEDFATYYCQQYNSYPRTFGGGTKVEIK

SEQ ID NO: 3788 - protein, 107 aa, Artificial Sequence
  Description of Artificial Sequence: Synthetic polypeptide
QIVLTQSPAIMSASPGEKVTMTCSASSSVRYMHWYQQKSGTSPKRWIYDTSKLASGVPARFSGSGSGTSYSLTISSMEAEDAATYYCQQWSGNPLTFGAGTKLEIKR

SEQ ID NO: 3789 - protein, 113 aa, Artificial Sequence
  Description of Artificial Sequence: Synthetic polypeptide
DIQMTQSPLTLSVTFGQPASISCKSSQSLLASDGETYLNWLLQRPDQSLKRLIYLVSKLDSGVPDRFTGSGSGTDFTLKISRVEAEDLGVYYCWQGTHFPQTFGGGTELEFKR

SEQ ID NO: 3790 - protein, 107 aa, Artificial Sequence
  Description of Artificial Sequence: Synthetic polypeptide
ENVLTQSPAIMSASLGEKVTMSCRASPSINNMYWYQQKADASPKLWIYYTSNLAPGPARFSGSGSGNSYSLTISSMEGEDAATYYCQQFTSSPSALTFGAGTKLELK

SEQ ID NO: 3791 - protein, 134 aa, Artificial Sequence
  Description of Artificial Sequence: Synthetic polypeptide
DIQMTQTTSSLSASLGDRVTVSCRASQDIRNYLNWYQQKPDGTVKFLIYYTSRLLPGVPSRFSGSGSGTDYSLTINNLEQEDIGTYFCQQGNTPPWTFGGGTKLEIKRGGGGSDGGGSGGGGSGGGGSEVQLQQ

SEQ ID NO: 3792 - protein, 106 aa, Artificial Sequence
  Description of Artificial Sequence: Synthetic polypeptide
EIVLTQSPSTLSASVGDRVIITCRASQRIRNELAWYQQKPGKAPKVLIYKASTLESGVPSRFSGSGSGTEFTLTISSLQPDDFATYYCQQYSGLWTFGQGTKLEIK

SEQ ID NO: 3793 - protein, 109 aa, Artificial Sequence
  Description of Artificial Sequence: Synthetic polypeptide
DIQVTQSPSSLSASVGDRVTITCRASQGIDRALAWYQQKSGRPPKLLIYDASSLESGVPSRFSGSGSGTDFTLTISSLQPEDFATYYCQQYKSYLRELTFGGGTKVEIK

SEQ ID NO: 3794 - protein, 111 aa, Artificial Sequence
  Description of Artificial Sequence: Synthetic polypeptide
QSVLTQPPSVSVAPGTTARITCAGNNFASKNVHWYQQKPGQAPVLVVSADSDRPSEIPERFSASSTGNTATLTISRVDAGDEADYYCQVWDSSRDDRFVVFGGGTKLTVLG

SEQ ID NO: 3795 - protein, 108 aa, Artificial Sequence
  Description of Artificial Sequence: Synthetic polypeptide
QSVLTQPPSVSVSPGQTASITCSGDKLGHKYACWYQQKPGQSPVLVIYRDNKRPSGIPERFSGSNSGHTATLTISGTQALDEADYYCQAWDSSTHVIFGGGTKLTVLG

SEQ ID NO: 3796 - protein, 213 aa, Artificial Sequence; identical to SEQ ID NO: 3584
  Description of Artificial Sequence: Synthetic polypeptide

SEQ ID NO: 3797 - protein, 108 aa, Artificial Sequence
  Description of Artificial Sequence: Synthetic polypeptide
AAELTQSPATLSLSPGERATLSCRASQSVSTYLAWYQQRPGQSPRLLIYGASNRATGIPARFSGSGSGTDFTLTINSVEPEDFAVYYCHQYDAQPTFGHGTRVDFKRT

SEQ ID NO: 3798 - protein, 109 aa, Artificial Sequence
  Description of Artificial Sequence: Synthetic polypeptide
AAELTQSPSSLSASVGDRVSITCRASQSISNYLSWYQQKPGKAPQLLIYDASTLQSGVPSRFSGSGSGTDFTLTISSLQPEDFATYYCQCGYGTYPTFGGGTQVEIKRT

SEQ ID NO: 3799 - protein, 109 aa, Artificial Sequence
  Description of Artificial Sequence: Synthetic polypeptide
AAELTQSPSSLSASVGDRVTITCRASQGIRNYLAWYQQKPGKVPKLLIYAASTLQSGVPSRFSGSGSGTDFTLTISSLQPEDVATYYCQKYSSAPFTFGPGTKVGIKRT

SEQ ID NO: 3800 - protein, 109 aa, Artificial Sequence
  Description of Artificial Sequence: Synthetic polypeptide
ELVMTQSPSLLSASVGDRVTITCRASQGISNYLAWFQQKPGKAPKRLIFTAYRLESGVPSRFSGSMSGTEFTLTISSLEPEDFATYYCLQHSAYPPTFGQGTKLEIKRT

SEQ ID NO: 3801 - protein, 248 aa, Artificial Sequence
  Description of Artificial Sequence: Synthetic polypeptide
QVQLVESGGGVVQSGGSLRLSCSASGFTFSDYGMHWVRQAPGKGLEWVAVVSYDGSNIYYIDSVKGRFTISRDDSKNTLYLQMNSLRAEDTALYYCAKAGRRTQLQPRDFLFEYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 3802 - protein, 251 aa, Artificial Sequence
  Description of Artificial Sequence: Synthetic polypeptide
QVQLVQSGAEVRKPGASVKVSCKASGYMFTGYYMHWVRQAPGQGLEWMGWIKPYSGGTNYAQKFHDRVTMTRDTSISTAYMEVMRLTSDDSAVFYCARSRYSSSPFRGGLDVWGRGTMVTVSSGGGGSGGGGSGGGGSAQAVLTQPSSVSGAPGQRVTISCTGSSSNIGDGYDVHWYQQLPGTAPKLLIYGNTNRPSGVPDRFSGSKSDTSASLAITGLQVEDEADYFCHSYDSSISGWIFGGGTKVTVLG

SEQ ID NO: 3803 - protein, 246 aa, Artificial Sequence
  Description of Artificial Sequence: Synthetic polypeptide
EVQLLESGGGLVQPGGSLRLSCAASGFTFSSYATSWVRQAPGKGLEWVSAISGSGGSTYYADSVKGRFTISRDNSKNTLYLQMNSLRAEDTAVYYCARVGGAIRFDSWGRGTLVTVSSGGGGSGGGGSGGGGSALSYELTQPPSASETPGQRVSISCSGGTSNIGSNTINWYQQVPGTAPKLLIYFNNRRPAGVPARFSASKSGTSASLTISGLQSEDEADYYCSAWDDSLSGVVFGGGTKLTVLG

SEQ ID NO: 3804 - protein, 244 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARQIWGRFEYWGRGTTVTVSSGGGGSGGGGSGGGGSAQAVLTQPSSASGTPGQRVTISCSGSSSNIGTNTVNWYQQLPGTAPKLLIFSNNQRPSGVPDRFSGSKSGPSASLAISGLQSEDEADYYCAAWDDRLNGYVFGTGTKLTVLG

SEQ ID NO: 3805 - protein, 244 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCATQAFARFEFWGRGTLVTVSSGGGGSGGGGSGGGGSAQSVVTQPPSVSGTPGQRVTISCSGSSSNIGTNTVNWYQQLPGTAPKLLIYSNNQRPSGVPDRFSGSKSGTSASVAISGLQSEDEADYYCSSWDDSLNGVVFGGGTKLTVLG

SEQ ID NO: 3806 - protein, 244 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARQIWGRFEYWGRGTTVTVSSGGGGSGGGGSGGGGSAQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVLG

SEQ ID NO: 3807 - protein, 248 aa, Artificial Sequence
  Description of Artificial Sequence: Synthetic polypeptide
EVQLLESGGGLLQPGGSLRLSCAASGFSFISYAMSWVRQAPGKGLEWVSAISGSGGSTYYADSVKGRFTISRDNSKNTLYLQMNSLRAEDTAVYYCARVDHKWDLPFDYWGRGTLVTVSSGGGGSGGGGSGGGGSALSYVLTQPPSASGTPGQRVVVSCSGGSSNIGKNPVTWYQHLPGTAPKLLISRNTQRPSGVPDRFSGSKSGTSASLAISGLQSEDEADYYCAAWDDSLKGWVFGGGTKLTVLG

SEQ ID NO: 3808 - protein, 244 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARQIWGRFEYWGRGTTVTVSSGGGGSGGGGSGGGGSAQSVLTQPPSASGTPGQRVTISCSGSSSNIGSNTVNWYQQLPGTAPKLLIYSNNQRPSGVPDRFSGSKSGTSASLAVSGLQSEDEADYYCAAWDDSLNGVVFGGGTKLTVLG

SEQ ID NO: 3809 - protein, 244 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCARQIWGRFEYWGKGTMVTVSSGGGGSGGGGSGGGGSAQSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVLG

SEQ ID NO: 3810 - protein, 247 aa, Artificial Sequence
  Description of Artificial Sequence: Synthetic polypeptide
QVQLVESGGGVVQSGGSLRLSCSASGFTFSDYGMHWVRQAPGKGLEWVAVVSYDGSNIYYIDSVKGRFTISRDDSKNTLYLQMNSLRAEDTALYYCAKAGRRTQLQPRDFLEYWGQGTLVTVSSGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLG

SEQ ID NO: 3811 - protein, 239 aa, Artificial Sequence
  Description of Artificial Sequence: Synthetic polypeptide
QVQLVQSGAEVRKPGASVKVSCKASGYMFTGYYMHWVRQAPGQGLEWMGWIKPYSGGTNYAQKFHDRVTMTRDTSISTAYMEVMRLTSDDSAVFYCARSRYSSSPFRGGLDVWGRGTMVTVSSGGGGSGGGGSGGGGSAQAVLTQPSSVSGAPGQRVTISCTGSSSNIGDGYDVHWYQQLPGTAPKLLIYGNTNRPSGVPDRFSGSKSDTSASLAITGLQVEDEADYFCHSYDSFGGGT

SEQ ID NO: 3812 - protein, 137 aa, Artificial Sequence
  Description of Artificial Sequence: Synthetic polypeptide
MAWVWTLLFLMAAAQSAQAQVQLVQSGAEVKKPGASVKVSCKASGYTFTSYAISWNWVRQAPGQKLEWMGWINGNGDTNYAQKFQGRVTITADTSTSTAYMELSSLRSEDTAVYYCARAPGYGSDYWGQGTLVTVSS

SEQ ID NO: 3813 - protein, 126 aa, Artificial Sequence
  Description of Artificial Sequence: Synthetic polypeptide
MAWVWTLLFLMAAAQSAQADIQMTQSPSSLSASVGDRVTITCRASQSISNYLAWYQQKPGKAPKLLIYAASSLESGVPSRFSGSGSGTRFTLTISSLQPEDFATYYCQQYNSLPWTFGQGTKVEIK

SEQ ID NO: 3814 - protein, 111 aa, Artificial Sequence
  Description of Artificial Sequence: Synthetic polypeptide
LVQVGGSLRLSCVVSGSDISGIAMGWYRQAPGKRREMVADIFSGGSTDYAGSVKGRFTISRDNAKKTSYLQMNNVKPEDTGVYYCRLYGSGDYWGQGTQVTVSSAHHSEDP

SEQ ID NO: 3815 - protein, 115 aa, Artificial Sequence
  Description of Artificial Sequence: Synthetic polypeptide
LVHPGGSLRLSCAPSASLPSTPFNPFNNMVGWYRQAPGKQREMVASIGLRINYADSVKGRFTISRDNAKNTVDLQMDSLRPEDSATYYCHIEYTHYWGKGTLVTVSSEPKTPKPQ

SEQ ID NO: 3816 - protein, 269 aa, Artificial Sequence
  Description of Artificial Sequence: Synthetic polypeptide
QVQLVESGGGLVQVGGSLRLSCVVSGSDISGIAMGWYRQAPGKRREMVADIFSGGSTDYAGSVKGRFTISRDNAKKTSYLQMNNVKPEDTGVYYCRLYGSGDYWGQGTQVTVSSAHHSEDPTSAIAGGGGSGGGGSGGGGSLQGQLQLVESGGGLVHPGGSLRLSCAPSASLPSTPFNPENNMVGWYRQAPGKQREMVASIGLRINYADSVKGRFTISRDNAKNTVDLQMDSLRPEDSATYYCHIEYTHYWGKGTLVTVSSEPKTPKPQ

SEQ ID NO: 3817 - protein, 132 aa, Artificial Sequence
  Description of Artificial Sequence: Synthetic polypeptide
QVQLVESGGGLVQPGGSLRLSCVVSGSDFNTYIMGWYRQVPGKPRELVADITTEGKTNYGGSVKGRFTISRDNAKNTVYLQMFGLKPEDAGNYVCNADWKMGAWTAGDYGIDYWGKGTLVTVSSEPKTPKPQ

SEQ ID NO: 3818 - protein, 136 aa, Artificial Sequence
  Description of Artificial Sequence: Synthetic polypeptide
QVQLVESGGGLVQPGGSLRLSCAASAGNLDYYAIGWFRQAPGKEREGVSCISSSDGSTVYTDSVKGRFTISRDNTKNTVDLQMDNLKPEDTAVYYCATVVNYYCTAGGSIHASPYEIWGQGTQVTVSSAHHSEDPS

SEQ ID NO: 3819 - protein, 133 aa, Artificial Sequence
  Description of Artificial Sequence: Synthetic polypeptide
QVQLVESGGGLVHPGGSLRLSCAPSASLPSTPFNPFNNMVGWYRQAPGKQREMVASIGLRINYADSVKGRFTISRDNAKNTVDLQMDSLRPEDSATYYCHIEYTHYWGKGTLVTVSSEPKTPKPQEPKTPKPQ

SEQ ID NO: 3820 - protein, 126 aa, Artificial Sequence
  Description of Artificial Sequence: Synthetic polypeptide
QVQLVESGGGLAQPGGSLRLSCEASGFGTWFRFDENTVNWYRQPPGKSREFDELVARYPKSGIVTYLDSVKGRFTISRDNAKKMAFLQMDNLKPEDTAVYYCNVGEFWGQGTQVTISSEPKTPKPQ

SEQ ID NO: 3821 - protein, 128 aa, Artificial Sequence
  Description of Artificial Sequence: Synthetic polypeptide
QVQLVESGGGLVQPGGSLRLSCAASGFTLGSRYMSWVRQAPGEGFEWVSSIEPSGTAWDGDSAKGRFTTSRDDAKNTLYLQMSNLQPEDTGVYYCATGYRTDTRIPGGSWGQGTQVTVSSEPKTPKPQ

SEQ ID NO: 3822 - protein, 120 aa, Artificial Sequence
  Description of Artificial Sequence: Synthetic polypeptide
QVQLVESGGGLVQPGGSLRLSCQVSGFTFGDWVMSWFRQAPGKEREFVASITATSSLKYYADSVKGRFTISRDNVNNTLFLQMDRLKSEDTAVYYCRSPNYWGQGTQVTVSAEPKTPKPQ

SEQ ID NO: 3823 - protein, 122 aa, Artificial Sequence
  Description of Artificial Sequence: Synthetic polypeptide
QVQLVESGGGLVQVGGSLRLSCVVSGSDISGIAMGWYRQAPGKRREMVADIFSGGSTDYAGSVKGRFTISRDNAKKTSYLQMNNVKPEDTGVYYCRLYGSGDYWGQGTQVTVSSAHHSEDPS

SEQ ID NO: 3824 - protein, 137 aa, Artificial Sequence
  Description of Artificial Sequence: Synthetic polypeptide
QVQLVESGGGLVQPGGSLKLSCAASGFTLGHHRVGWFRQAPGKKREGVACISATGLSTHYSDSVTGRFTVSRDNLNNVAYLQLNSLKPEDAGVYYCASRFSLNSVDANMCLSEPQYDNWGQGTQVRISSEPKTPKPQ

SEQ ID NO: 3825 - protein, 133 aa, Artificial Sequence
  Description of Artificial Sequence: Synthetic polypeptide
QVQLVESGGGLVQAGGSLRLSCAGSGRSFSAAVMGWFRQAPGKEREFVAALRQIIGSTHYADSVKGRFTISRDNAKNMLYLDMNSLKPTDTAAYYCTAGPPTMLDVSTDREYDTWGQGTQVTVSSAHHSEDPS

SEQ ID NO: 3826 - protein, 121 aa, Artificial Sequence
  Description of Artificial Sequence: Synthetic polypeptide
QVQLVESGGGLVRPGGSLRLSCVVSGFAYEMPMMGWYRQAPGNQRELVATIGTGGRMNYADSVKGRFTISRDNAKNTVYLQMNSLKPEDTAAYYCKIEFTNYWGQGTQVTVSSEPKTPKPQ

SEQ ID NO: 3827 - protein, 122 aa, Artificial Sequence
  Description of Artificial Sequence: Synthetic polypeptide
QVQLVESGGGLVQPGGSLRLSCTVSGSIFDLPGMNWYRQAPGAQRELVADISSDGRRTNYADSVKGRFTMSRDNAKKTVYLQMDSLKPDDTAVYYCNVKFTHHWGQGIQVTVSSEPKTPKPQ

SEQ ID NO: 3828 - protein, 122 aa, Artificial Sequence
  Description of Artificial Sequence: Synthetic polypeptide
QVQLVESGGGLVQPGGSLRLSCTVSGSIFGLPGMSWYRQAPGAQRELVADISSDGGRTHYADSVKGRFTISRDNDKKTVYLQMDSLKPDDTAVYYCNVKFTHHWGQGIQVTVSSEPKTPKPQ

SEQ ID NO: 3829 - protein, 122 aa, Artificial Sequence
  Description of Artificial Sequence: Synthetic polypeptide
QVQLVESGGGLVQDGGSLRLSCTTSGSIDSFNAIEWYRQAPGKQRELVASISSDGRRTNYADSVKGRFTISGDNAKNTVYLQMNSLKPEDTAVYYCHRPFTHYWGQGTQVTVSSEPKTPKPQ

SEQ ID NO: 3830 - protein, 303 aa, Artificial Sequence
  Description of Artificial Sequence: Synthetic polypeptide
MSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLAGSGSGHMHHHHHHSSGLVPRGSGMKETAAAKFERQHMDSPDLGTDDDDKAMAISDPNSQVQLVESGGGLVQVGGSLRLSCVVSGSDISGIAMGWYRQAPGKRREMVADIFSGGSTDYAGSVKGRFTISRDNAKKTSYLQMNNVKPEDTGVYYCRLYGSGDYWGQGTQVTVSSAHHSEDPTSGAPVPYPDPLEPR

SEQ ID NO: 3831 - protein, 307 aa, Artificial Sequence
  Description of Artificial Sequence: Synthetic polypeptide
MSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLAGSGSGHMHHHHHHSSGLVPRGSGMKETAAAKFERQHMDSPDLGTDDDDKAMAISDPNSQVQLVESGGGLVHPGGSLRLSCAPSASLPSTPFNPFNNMVGWYRQAPGKQREMVASIGLRINYADSVKGRFTISRDNAKNTVDLQMDSLRPEDSATYYCHIEYTHYWGKGTLVTVSSEPKTPKPQTSGAPVPYPDPLEPR

SEQ ID NO: 3832 - protein, 449 aa, Artificial Sequence
  Description of Artificial Sequence: Synthetic polypeptide
MSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLAGSGSGHMHHHHHHSSGLVPRGSGMKETAAAKFERQHMDSPDLGTDDDDKAMAAAQVQLVESGGGLVQVGGSLRLSCVVSGSDISGIAMGWYRQAPGKRREMVADIFSGGSTDYAGSVKGRFTISRDNAKKTSYLQMNNVKPEDTGVYYCRLYGSGDYWGQGTQVTVSSAHHSEDPTSAIAGGGGSGGGGSGGGGSLQGQLQLVESGGGLVHPGGSLRLSCAPSASLPSTPFNPFNNMVGWYRQAPGKQREMVASIGLRINYADSVKGRFTISRDNAKNTVDLQMDSLRPEDSATYYCHIEYTHYWGKGTLVTVSSEPKTPKPQPARQGAPVPYPDPLEPR

SEQ ID NO: 3833 - protein, 469 aa, Artificial Sequence
  Description of Artificial Sequence: Synthetic polypeptide
MSDKIIHLTDDSFDTDVLKADGAILVDFWAEWCGPCKMIAPILDEIADEYQGKLTVAKLNIDQNPGTAPKYGIRGIPTLLLFKNGEVAATKVGALSKGQLKEFLDANLAGSGSGHMHHHHHHSSGLVPRGSGMKETAAAKFERQHMDSPDLGTDDDDKAMAISDPNSGAPVPYPDPLEPRAAAQVQLVESGGGLVQVGGSLRLSCVVSGSDISGIAMGWYRQAPGKRREMVADIFSGGSTDYAGSVKGRFTISRDNAKKTSYLQMNNVKPEDTGVYYCRLYGSGDYWGQGTQVTVSSAHHSEDPTSAIAGGGGSGGGGSGGGGSLQGQLQLVESGGGLVHPGGSLRLSCAPSASLPSTPFNPFNNMVGWYRQAPGKQREMVASIGLRINYADSVKGRFTISRDNAKNTVDLQMDSLRPEDSATYYCHIEYTHYWGKGTLVTVSSEPKTPKPQPARQGAPVPYPDPLEPR

SEQ ID NO: 3834 - protein, 111 aa, Artificial Sequence; identical to SEQ ID NO: 3814
  Description of Artificial Sequence: Synthetic polypeptide

SEQ ID NO: 3835 - protein, 115 aa, Artificial Sequence; identical to SEQ ID NO: 3815
  Description of Artificial Sequence: Synthetic polypeptide

SEQ ID NO: 3836 - protein, 269 aa, Artificial Sequence
  Description of Artificial Sequence: Synthetic polypeptide
QVQLVESGGGLVQVGGSLRLSCVVSGSDISGIAMGWYRQAPGKRREMVADIFSGGSTDYAGSVKGRFTISRDNAKKTSYLQMNNVKPEDTGVYYCRLYGSGDYWGQGTQVTVSSAHHSEDPTSAIAGGGGSGGGGSGGGGSLQGQLQLVESGGGLVHPGGSLRLSCAPSASLPSTPFNPFNNMVGWYRQAPGKQREMVASIGLRINYADSVKGRFTISRDNAKNTVDLQMDSLRPEDSATYYCHIEYTHYWGKGTLVTVSSEPKTPKPQ

SEQ ID NO: 3837 - protein, 272 aa, Artificial Sequence
  Description of Artificial Sequence: Synthetic polypeptide
  MOD_RES (16)..(17): Any amino acid
QAVLTQPSSVSGSPGXXVSITCSGSRSNVGTYGVGWFQQLPGSGLRTIIYYNDKRPSGVPDRFSASKSGNTATLIISSLQAEDEADYFCGSADGSSYGIFGSGTRLTVLGQPAAAGGGGSGGGGSGGGGSARQVGLQESGPSLVKPSQTLSLTCTVSGFSLSNSVVGWVRQAPGKVPEWLGSIDSGGYTVADPALKSRLSITRDTSKSQVSLSLNSVTTEDTAVYYCTRAYSITYYAYPPYIDYWGPGLLVTVSSTSGAPVPYPDPLEPRAA

SEQ ID NO: 3838 - protein, 275 aa, Artificial Sequence
  Description of Artificial Sequence: Synthetic polypeptide
QAVLTQPSSVSRSLGQSVSITCSGSSSNVGYGDYVGWFQRVPGSAPKLLIYGATTRASGVPDRFSGSRSGNTATLTISSLQAEDEADYYCSSYDSSHYSIFGSGTSLTVLGQPAAAGGGGSGGGGSGGGGSARQVELQESGPSLVKPSQTLSLTCTVSGFSLSSNAVGWVRQAPGKAPEWVGGIDIDGRPVYKPGLKSRLSITRDTSNAQVSLSLSSVTTEDTAVYFCASYYGGYLYNYAPGAYIEHLSPGLLITVSSTSGAPVPYPDPLEPRAA

SEQ ID NO: 3839 - protein, 272 aa, Artificial Sequence
  Description of Artificial Sequence: Synthetic polypeptide
SYELTQPPSMSVALGQTAKVTCQGDNLENFYVQWHQQKPGQAPVTVIFQDNKRPSGIPDRFSGSNSGNTATLTISGARTEDEADYYCQSGHSSIGGVFGSGTSLTVLGQPAAAGGGGSGGGGSGGGGSARQVQLQESGPSLVKPSQTLSLTCTVSGFSLTGNSVTWVRQAPGNVPEWLGGISRGGRTYYDTALKSRLSITRDTSKRQVSLSLSSVTTEDTAMYFCARSAYSTLYDYEYAADIYDWGPGLLVTVSSTSGAPVPYPDPLEPRAA

SEQ ID NO: 3840 - protein, 265 aa, Artificial Sequence
  Description of Artificial Sequence: Synthetic polypeptide
  MOD_RES (16)..(17): Any amino acid
SYELTQPPSVSVVWGXXAEITCQGDLLDKKYTAWYQQKPGQAPMKIINKDSERPSGIRDRFSGSSSGKTATLTINGARPEDEADYYCLSGDSNNNGVFGSGTSLTVLGQPAAAGGGGSGGGGSGGGGSARQVELQGSGPSLVKPSQTLSLTCTVSGFSWPNNAVDWVRQAPGKAPEWLGGIADNGRTNYNTALKARLSITRDTAKSHVSLSLSSVTAEDTAVYYCTAGVMVMHATDYWGPGLLVTVSSTSGAPVPYPDPLEPRAA

SEQ ID NO: 3841 - protein, 270 aa, Artificial Sequence
  Description of Artificial Sequence: Synthetic polypeptide
  MOD_RES (16)..(17): Any amino acid
QAVVTQPSSVSGSPGXXVSITCSGSSSNVGRYAVGWFQQLPGSGLRTVIYYNSNRPSGVPDRFSGSKSGNTATLTISSLQAEDEADYFCGSYDSSIYGVFGSGTRLTVLGQPAAAGGGGSGGGGSGGGGSARQVQLQESGPSLVRPSQTLSLTCTISGFSLREYGVGWVRQAPGKALEWLGRIDDSGYTLHNPALKSRLTITRDISKSQVSLSLSSVTLEDTAEYYCVYASRGTAWLGDIDVWGPGLLLTVSSTSGAPVPYPDPLEPRAA

SEQ ID NO: 3842 - protein, 272 aa, Artificial Sequence
  Description of Artificial Sequence: Synthetic polypeptide
  MOD_RES (16)..(17): Any amino acid
QAVLTQPSSVSRSLGXXVSITCSGGSSNVGQGDYVAWFQQVPGSAPKLLIYDATNRASGVPDRFVGSRYGNSATLIITSVQAEDEADYYCASYDSSMYTIFGSGTSLTVLGQPAAAGGGGSGGGGSGGGGSARQVELQGSGPSQVKPSQTLSLICTISGFSLTSNNVAWVRQAPGKGLEWVGVISDGGTPYYNSALKSRLSITRDTSKSQVSLSLSSVTTEDTAVYYCARTLDYSHIWLYSADQWGPGLLVTVSSTSGAPVPYPDPLEPRAA

SEQ ID NO: 3843 - protein, 287 aa, Artificial Sequence
  Description of Artificial Sequence: Synthetic polypeptide
GAPVPYPDPLEPRAGSYELTQPPSMSVALGQTAKVTCQGDNLENFYVQWHQQKPGQAPVTVIFQDNKRPSGIPDRFSGSNSGNTATLTISGARTEDEADYYCQSGHSSIGGVFGSGTSLTVLGQPAAAGGGGSGGGGSGGGGSARQVQLQESGPSLVKPSQTLSLTCTVSGFSLTGNSVTWVRQAPGNVPEWLGGISRGGRTYYDTALKSRLSITRDTSKRQVSLSLSSVTTEDTAMYFCARSAYSTLYDYEYAADIYDWGPGLLVTVSSTSGAPVPYPDPLEPRAA

SEQ ID NO: 3844 - protein, 133 aa, Artificial Sequence
  Description of Artificial Sequence: Synthetic polypeptide
QVQLVETGGGLVQAGDPLRLSCVASGRTVSRYDKAWFRQAPGKEREFVAGISWNGDTKIYADSVKGRFTISRENSRDTLDLQIDNLKPEDTAAYYCAVGIAGVQSMARMLGVRYWGQGTQVTVSSEPKTPKPQ

SEQ ID NO: 3845 - protein, 138 aa, Artificial Sequence
  Description of Artificial Sequence: Synthetic polypeptide
QVQLVETGGGLVQPGGSLRLSCAASGFSLDPYVIGWFRQAPGKEREGVSCITSRAASRTSVDSVNERFTISRDNAKNTVDLHINNLKPEDSGVYYCAAVPPAKLPLFSLCRSLPAKYDYWGQGTQVTVSSAHHSEDPS

SEQ ID NO: 3846 - protein, 119 aa, Artificial Sequence
  Description of Artificial Sequence: Synthetic polypeptide
EVQLQQPGPELEKPGASVKLSCKASGYSFTDYNMNWVKQNNGESLEWIGKIDPYYGGPSYNQKFKDKATLTVDKSSSTAYMQFKSLTSEDSAVYYCTRGGNRDWYFDVWGAGTTLTVSA

SEQ ID NO: 3847 - protein, 108 aa, Artificial Sequence
  Description of Artificial Sequence: Synthetic polypeptide
DIVMSQSHKFMSTSVGDRVSITCKASQDVGTAVAWYQQNPGQSPKFLIYWASTRHTGVPDRFTGSGSGTDFTLTITNVQSEDLADYFCQQYSSYPLTFGAGTSLELKR

SEQ ID NO: 3848 - protein, 122 aa, Artificial Sequence
  Description of Artificial Sequence: Synthetic polypeptide
QVQLQESGAELVRSGASVRMSCDASGYTFTSYNMHWVKQTPGQGLEWIGYIYPGNGGTNYIQKFKGKAILTADTSSSTAYMQISSLTSEDSAVYFCTRSPSHYSSDPYFDYWGQGTTLTVSS

SEQ ID NO: 3849 - protein, 108 aa, Artificial Sequence; identical to SEQ ID NO: 3847
  Description of Artificial Sequence: Synthetic polypeptide

SEQ ID NO: 3850 - protein, 119 aa, Artificial Sequence; identical to SEQ ID NO: 3846
  Description of Artificial Sequence: Synthetic polypeptide

SEQ ID NO: 3851 - protein, 113 aa, Artificial Sequence
  Description of Artificial Sequence: Synthetic polypeptide
DIVLSQSPSSLVVSVGEKVTMSCKSSQSLLYSRNQKNYLAWYQQKPGQSPKVLIYWASTRESGVPDRLTGSGSGTDFTLTISSVKAEDLAVYYCQQYYSYPLTFGAGTKLELK

SEQ ID NO: 3852 - protein, 113 aa, Artificial Sequence
  Description of Artificial Sequence: Synthetic polypeptide
EVQLQESGGGLVQPGGSLKLACAASGITFRNKAIGWYRQAPGKGLELVARIDSFDTTDYADSVKGRFSISRDNSKNTLYLQMNSLRAEDTAVYYCNLRGSNYWGQGTLVTVSS

SEQ ID NO: 3853 - protein, 113 aa, Artificial Sequence
  Description of Artificial Sequence: Synthetic polypeptide
EVQLQESGGGLVQPGGSLRLSCAASGITFRNKAIGWYRQAPGKGLELVARIDSFDTTDYADSVKGRFTISRDNSKNTLYLQMNSLRAEDTAVYYCNLRGSNYWGQGTLVTVSS

SEQ ID NO: 3854 - protein, 113 aa, Artificial Sequence
  Description of Artificial Sequence: Synthetic polypeptide
QVQLQESGGGLVQPGGSLKLACAASGITFRNKAIGWYRQAPGKGRELVARIDSFDTTDYADSVKGRFSISRDNAKNTVYLQMNSLKSEDTAVYYCNLRGSNYWGQGTQVTVSS

SEQ ID NO: 3855 - protein, 113 aa, Artificial Sequence
  Description of Artificial Sequence: Synthetic polypeptide
QVQLQESGGGLVQAGGSLRLSCAASGITFRRKAIGWYRQAPGKQRELVARIDSDDITDYADSVKGRFSISRDNAKNTVYLQMNSLKSEDTAVYYCNLRGSNYWGQGTQVTVSS

SEQ ID NO: 3856 - protein, 113 aa, Artificial Sequence
  Description of Artificial Sequence: Synthetic polypeptide
QVQLQESGGGLVQAGGSLRLSCAASGITFRRKAIGWYRQAPGKQRELVARIDSDDITDYADSVKGRFSISRDNAKNMVYLQMNSLKSEDTAVYYCNLRGSNYWGQGTQVTVSS

SEQ ID NO: 3857 - protein, 113 aa, Artificial Sequence
  Description of Artificial Sequence: Synthetic polypeptide
QVQLQESGGGLVQAGGSLRISCAASGITFRRRAIGWYRQAPGKQRELVARIDSDDITNYADSVKGRFSISRDNAKNTVFLQMNSLKSEDTAIYYCNLRGSNYWGQGTQVTVSS

SEQ ID NO: 3858 - protein, 113 aa, Artificial Sequence
  Description of Artificial Sequence: Synthetic polypeptide
QVQLQESGGGLVQAGGSLRISCAASGITFRRKAIGWYRQAPGKQRELVARIDSDDITNYADSVKGRFSISRDNAKNTVFLQMNSLKSEDTAIYYCNLRGSNYWGQGTQVTVSS

SEQ ID NO: 3859 - protein, 113 aa, Artificial Sequence
  Description of Artificial Sequence: Synthetic polypeptide
QVQLQESGGGLVQAGGSLRLSCAASGITFRRKAIGWYRQAPGKQRELVARIDSDDITNYADSVKGRFSISRDNAKNTVFLQMNSLKSEDTAVYYCNLRGSNYWGQGTQVTVSS

SEQ ID NO: 3860 - protein, 113 aa, Artificial Sequence
  Description of Artificial Sequence: Synthetic polypeptide
QVQLQESGGGLVQPGGSLRLSCVASGFSFRRKAIGWYRQAPGKQRELVARIDSDDITNYADSVKGRFSISRDNAKNTVFLQMNSLKSEDTAVYYCNLRGSNYWGQGTQVTVSS

SEQ ID NO: 3861 - protein, 113 aa, Artificial Sequence
  Description of Artificial Sequence: Synthetic polypeptide
QVQLQESGGGLVQPGGSLRLSCAASGITFRNKAIGWYRQAPGKQRELVARIDSGDITDYADSVKGRFSISRDNAKNTVYLQMNSLKSEDTAVYYCNLRGSNYWGQGTQVTVSS

SEQ ID NO: 3862 - protein, 113 aa, Artificial Sequence
  Description of Artificial Sequence: Synthetic polypeptide
QVQLQESGGGLVQAGGSLRLSCAASGITFRGKAIGWYRQAPGKQRELVARIDSGDITDYADSVKGRFSISRDNAKNTVYLQMNSLKSEDTAVYYCNLRGSNYWGQGTQVTVSS

SEQ ID NO: 3863 - protein, 113 aa, Artificial Sequence
  Description of Artificial Sequence: Synthetic polypeptide
QVQLQESGGGLVQAGGSLRLSCAASGIIFRNKAIGWYRQAPGKQRELVARIDSYDSTVYADSVKGRFSISRDNAKNTVYLQMNNPKSEDTAVYYCNLRGSNYWGQGTQVTVSS

SEQ ID NO: 3864 - protein, 113 aa, Artificial Sequence
  Description of Artificial Sequence: Synthetic polypeptide
QVQLQESGGGLVQAGGSLRLSCAASGITFRNKAIGWYRQAPGKQRELVARIDSYDITNYADSVKGRFSISRDNSKNTVYLQMNSLKSEDTAVYYCNLRGSNYWGQGTQVTVSS

SEQ ID NO: 3865 - protein, 113 aa, Artificial Sequence
  Description of Artificial Sequence: Synthetic polypeptide
QVQLQESGGGLVQAGGSLRLSCAASGITFRSKSVGWYRQAPGKQRELVGYISGGDITDYTDSVKGRFSISRDNAKNTVYLQMNSLKSEDTAVYYCNLRGSNYWGQGTQVTVSS

SEQ ID NO: 3866 - protein, 113 aa, Artificial Sequence
  Description of Artificial Sequence: Synthetic polypeptide
QVQLQESGGGLVQAGGSLRLSCAASGITFRGKSVGWYRQAPGKQRELVGYMSGGEITDYADSVKGRFSISRDNAKNTVYLQMNSLKSEDTAVYYCNLRGSNYWGQGTQVTVSS

SEQ ID NO: 3867 - protein, 113 aa, Artificial Sequence
  Description of Artificial Sequence: Synthetic polypeptide
QVQLQESGGGLVQAGGSLRLSCAASGITFRSKSVGWYRQHPGKQRELVGYISGADNIEYADSVKGRFSISRDNAKNTVYLQMNSLKSEDTAVYYCNLRGSNYWGQGTQVTVSS

SEQ ID NO: 3868 - protein, 113 aa, Artificial Sequence
  Description of Artificial Sequence: Synthetic polypeptide
QVQLQESGGGLVQAGGFLRLSCAASGITFRSKSVGWYRQAPGKQRELVAYISGDDITNYADSVKGRFSISRDNAKNTVYLQMNSLKSEDTAVYYCNLRGSNYWGQGTQVTVSS

SEQ ID NO: 3869 - protein, 113 aa, Artificial Sequence
  Description of Artificial Sequence: Synthetic polypeptide
QVQLQESGGGLVQPGGSLRLSCAASGIIFKSKAVGWYRQAPGTQREWVAYITGDDSTSYQDFVKGRFTISRDNAKNTVYLQMNNLKPEDTAVYYCNLRGSNYWGQGTQVTVSS

SEQ ID NO: 3870 - protein, 113 aa, Artificial Sequence
  Description of Artificial Sequence: Synthetic polypeptide
QVQLQESGGGLVQPGGSLRLSCAASGILFRSKAVGWYRQAPGTQREWVAYITGDDLTSYEDFVKGRFTISRDNAKNMVYLQMNSLKPEDTAVYYCNLRGSNYWGQGTQVTVSS

SEQ ID NO: 3871 - protein, 113 aa, Artificial Sequence
  Description of Artificial Sequence: Synthetic polypeptide
QVQLQESGGGLVQAGGSLRLSCAASGIIFRNKAIGWYRQAPGKQRELVARIDSADITNYPDSVKGRFSISRDNAKNTVYLQMNSLKSEDTAVYYCNLRGTNYWGQGTQVTVSS

SEQ ID NO: 3872 - protein, 113 aa, Artificial Sequence; identical to SEQ ID NO: 3871
  Description of Artificial Sequence: Synthetic polypeptide

SEQ ID NO: 3873 - protein, 113 aa, Artificial Sequence
  Description of Artificial Sequence: Synthetic polypeptide
QVQLQESGGGLVQAGGSLRLSCAASGIIFRGKAIGWYRQAPGKQRELVARIDAGDITNYADSVKGRFSISRDHAKNTVYLQMNSLKSEDTAVYYCNLRGTNYWGQGTQVTVSS

SEQ ID NO: 3874 - protein, 113 aa, Artificial Sequence
  Description of Artificial Sequence: Synthetic polypeptide
QVQLQESGGGLVQAGGSLRLSCAASGITFRRKAVGWYRQAPGKQRELVARIDSDDITNYADSVKGRFSISRDHAKNTVYLQMNSLKSEDTAVYYCNLRGTNYWGQGTQVTVSS

SEQ ID NO: 3875 - protein, 113 aa, Artificial Sequence
  Description of Artificial Sequence: Synthetic polypeptide
QVQLQESGGGLVQAGGSLRLSCAASGITLRNKSVGWYRQAPGRQRELVGYISGDDITNYVDSVKARFSISRDNAKNTVYLQMNSLKSEDTAVYYCNLRGANYWGQGTQVTVSS

SEQ ID NO: 3876 - protein, 113 aa, Artificial Sequence; identical to SEQ ID NO: 3875
  Description of Artificial Sequence: Synthetic polypeptide

SEQ ID NO: 3877 - protein, 118 aa, Artificial Sequence
  Description of Artificial Sequence: Synthetic polypeptide
QVQLQESGGGLVQAGGSLRLSCTASGSIFNTATMAWSRQAPGKQRELVASITQGRITYPVDSVKGRFTLSRDNSKNTVYLQMNSLEPEDTAVYYCGVDTIPTSRPRYWGQGTQVTVSS

SEQ ID NO: 3878 - protein, 116 aa, Artificial Sequence
  Description of Artificial Sequence: Synthetic polypeptide
QVQLQESGGGLVQAGGSLRLSCAASENPSSISTMAWYRQAPGKQRELVARIITGGYTNYLDSVMGRFTISRGNRESTAYLQMNSLKPEDTAVYICNARTWSSADYWGQGTQVTVSS

SEQ ID NO: 3879 - protein, 128 aa, Artificial Sequence
  Description of Artificial Sequence: Synthetic polypeptide
QVQLQESGGGLVQAGGSLRLSCAVSGRTGNIYAAMGWFRQAPGKQREFVSADSWNAGTTDYADSVKGRFTISRDNAKSTVYLQMNSLKPEDTAVYYCAAKIGLYDTSRGRFENEYDYWGQGTQVTVSS

SEQ ID NO: 3880 - protein, 126 aa, Artificial Sequence
  Description of Artificial Sequence: Synthetic polypeptide
QVQLQESGGGLVQAGGSLRLSCAASGRTGNIYAAMGWFRQAPGKQREFVSSDSWNGGSTDYADSVKGRFTISRDNAKSTVYLQMNSLKPEDTAVYYCAAKIGLHDTSRFENEYDYWGQGTQVTVSS

SEQ ID NO: 3881 - protein, 125 aa, Artificial Sequence
  Description of Artificial Sequence: Synthetic polypeptide
QVQLQESGGGLVQAGGSLRLSCAASGRTDIYAAMGWFRQAPGKQREFVASDSWNGGSTDYADSVKGRFTISRDNAKSTVNLQMNSLKPEDTAVYVCAAKIGLYGTTRFENEYDYWGQGTQVTVSS

SEQ ID NO: 3882 - protein, 126 aa, Artificial Sequence
  Description of Artificial Sequence: Synthetic polypeptide
QVQLQESGGGLVQAGGSLRLSCAVSGRTGSIYAAMGWFRQAPGKQREFVASDSWNALSTDYGDSVKGRFTISRDNAKNTVYLQMTTLKPEDTAVYYCAAKIGLYGTTRFENEYDYWGQGTQVTVSS

SEQ ID NO: 3883 - protein, 125 aa, Artificial Sequence
  Description of Artificial Sequence: Synthetic polypeptide
QVQLQESGGGLVQAGGSLRLDCAASARTSIYATVGWFRQVPGKQREFVSSVSWNGGSTDYTDSVKGRFTISRDNAKNTVVLQMNSLKPEDTAVYYCAAKIGLYGTRRFETDYDYWGQGTQVTVSS

SEQ ID NO: 3884 - protein, 121 aa, Artificial Sequence
  Description of Artificial Sequence: Synthetic polypeptide
QVQLQESGGGLAQAGGSLRLSCAASGFDFDYYAIGWFRQAPGKEREGVACITDSDGSTIYADSVRGRFTITADNAENTVYLQMNSLKPEDTAEYFCAAECFACSGYACHSWGRGTQVTVSS

SEQ ID NO: 3885 - protein, 124 aa, Artificial Sequence
  Description of Artificial Sequence: Synthetic polypeptide
QVQLQESGGGLVQPGGSLRLSCAASGFTIDYYAIAWFRQAPGEEREWVSCIRSGDGSTWYVDSVKGRFSISSDNAKNAVYLQISSLKPEDTAVYYCAASRGSPYCPAVIDYDYWGQGTQVTVSS

SEQ ID NO: 3886 - protein, 126 aa, Artificial Sequence
  Description of Artificial Sequence: Synthetic polypeptide
QVQLQESGGGLVQPGGSLRLSCAASGIIFRSKSVGWYRQAPGTQREWVAYISGDDSTNYEDFVKGRFTISRDNAKNTVYLQMNSVKPEDTAIYYCAADYRDYDELLLPVPPPYDYWGQGTQVTVSS

SEQ ID NO: 3887 - protein, 124 aa, Artificial Sequence
  Description of Artificial Sequence: Synthetic polypeptide
QVQLQESGGGLVQAGGSLRLSCVVSGGTFRLYGIGWFRQAPGKDREFVGFITWSSGRTYYSDSLKGRLTISRDNAKNSVDLQMNRLQPEDTAIYYCAANPTDTLRLSTPSYNHWGQGTQVTVSS

SEQ ID NO: 3888 - protein, 384 aa, Artificial Sequence
  Description of Artificial Sequence: Synthetic polypeptide
MAQVQLQESGGGLVQPGGSLKLACAASGITFRNKAIGWYRQAPGKGRELVARIDSFDTTDYADSVKGRFSISRDNAKNTVYLQMNSLKSEDTAVYYCNLRGSNYWGQGTQVTVSSGGGGSGGGGSGGGGSQVQLQESGGGLVQAGGSLRLSCAASGRNISEYVMGWFRQAPGKEREFVAAISWSAGNIYYADSVKGRFTISRDNAKNTVHLQMNTLRPEDTAVYYCAAGRYSAWYVAAYEYDYWGQGTQVTVSSGGGGSGGGGSGGGGSQVQLQESGGGLVQPGGSLKLACAASGITFRNKAIGWYRQAPGKGRELVARIDSFDTTDYADSVKGRFSISRDNAKNTVYLQMNSLKSEDTAVYYCNLRGSNYWGQGTQVTVSSHH

SEQ ID NO: 3889 - protein, 380 aa, Artificial Sequence
  Description of Artificial Sequence: Synthetic polypeptide
EVQLQESGGGLVQPGGSLKLACAASGITFRNKAIGWYRQAPGKGLELVARIDSFDTTDYADSVKGRFSISRDNSKNTLYLQMNSLRAEDTAVYYCNLRGSNYWGQGTLVTVSSGGGGSGGGGSGGGGSQVQLQESGGGLVQAGGSLRLSCAASGRNISEYVMGWFRQAPGKEREFVAAISWSAGNIYYADSVKGRFTISRDNAKNTVHLQMNTLRPEDTAVYYCAAGRYSAWYVAAYEYDYWGQGTQVTVSSGGGGSGGGGSGGGGSEVQLQESGGGLVQPGGSLKLACAASGITFRNKAIGWYRQAPGKGLELVARIDSFDTTDYADSVKGRFSISRDNSKNTLYLQMNSLRAEDTAVYYCNLRGSNYWGQGTLVTVSS

SEQ ID NO: 3890 - protein, 380 aa, Artificial Sequence
  Description of Artificial Sequence: Synthetic polypeptide
EVQLQESGGGLVQPGGSLKLACAASGITFRNKAIGWYRQAPGKGLELVARIDSFDTTDYADSVKGRFSISRDNSKNTLYLQMNSLRAEDTAVYYCNLRGSNYWGQGTLVTVSSGGGGSGGGGSGGGGSQVQLQESGGGLVQPGGSLRLSCAASGRNISEYVMGWFRQAPGKGLEFVAAISWSAGNIYYADSVKGRFTISRDNSKNTLYLQMNSLRAEDTAVYYCAAGRYSAWYVAAYEYDYWGQGTLVTVSSGGGGSGGGGSGGGGSEVQLQESGGGLVQPGGSLKLACAASGITFRNKAIGWYRQAPGKGLELVARIDSFDTTDYADSVKGRFSISRDNSKNTLYLQMNSLRAEDTAVYYCNLRGSNYWGQGTLVTVSS

SEQ ID NO: 3891 - protein, 380 aa, Artificial Sequence
  Description of Artificial Sequence: Synthetic polypeptide
EVQLQESGGGLVQPGGSLRLSCAASGITFRNKAIGWYRQAPGKGLELVARIDSFDTTDYADSVKGRFTISRDNSKNTLYLQMNSLRAEDTAVYYCNLRGSNYWGQGTLVTVSSGGGGSGGGGSGGGGSQVQLQESGGGLVQAGGSLRLSCAASGRNISEYVMGWFRQAPGKEREFVAAISWSAGNIYYADSVKGRFTISRDNAKNTVHLQMNTLRPEDTAVYYCAAGRYSAWYVAAYEYDYWGQGTQVTVSSGGGGSGGGGSGGGGSEVQLQESGGGLVQPGGSLRLSCAASGITFRNKAIGWYRQAPGKGLELVARIDSFDTTDYADSVKGRFTISRDNSKNTLYLQMNSLRAEDTAVYYCNLRGSNYWGQGTLVTVSS

SEQ ID NO: 3892 - protein, 380 aa, Artificial Sequence
  Description of Artificial Sequence: Synthetic polypeptide
EVQLQESGGGLVQPGGSLRLSCAASGITFRNKAIGWYRQAPGKGLELVARIDSFDTTDYADSVKGRFTISRDNSKNTLYLQMNSLRAEDTAVYYCNLRGSNYWGQGTLVTVSSGGGGSGGGGSGGGGSQVQLQESGGGLVQPGGSLRLSCAASGRNISEYVMGWFRQAPGKGLEFVAAISWSAGNIYYADSVKGRFTISRDNSKNTLYLQMNSLRAEDTAVYYCAAGRYSAWYVAAYEYDYWGQGTLVTVSSGGGGSGGGGSGGGGSEVQLQESGGGLVQPGGSLRLSCAASGITFRNKAIGWYRQAPGKGLELVARIDSFDTTDYADSVKGRFTISRDNSKNTLYLQMNSLRAEDTAVYYCNLRGSNYWGQGTLVTVSS

SEQ ID NO: 3893 - protein, 129 aa, Artificial Sequence
  Description of Artificial Sequence: Synthetic polypeptide
QVQLVETGGGLAQAGDSLRLSCVEPGRTLDMYAMGWIRQAPGEEREFVASISGVGGSPRYADSVKGRFTISKDNTKSTIWLQMNSLKPEDTAVYYCAAGGDIYYGGSPQWRGQGTRVTVSSEPKTPKPQ

SEQ ID NO: 3894 - protein, 132 aa, Artificial Sequence
  Description of Artificial Sequence: Synthetic polypeptide
QVQLVESGGGLVQAGGSLRLSCAASGRINGDYAMGWFRQAPGEEREFVAVNSWIGGSTYYTDSVKGRFTLSRDNAKNTLSLQMNSLKPEDTAVYYCAAGHYTDFPTYFKEYDYWGQGTQVTVSSEPKTPKPQ

SEQ ID NO: 3895 - protein, 132 aa, Artificial Sequence
  Description of Artificial Sequence: Synthetic polypeptide
QVQLVETGGLVQAGGSLRLSCAASGVPFSDYTMAWFRQAPGKEREVVARITWRGGGPYYGNSGNGRFAISRDIAKSMVYLHMDSLKPEDTAVYYCAASRLRPALASMASDYDYWGQGTQVSVSSEPKTPKPQ

SEQ ID NO: 3896 - protein, 124 aa, Artificial Sequence
  Description of Artificial Sequence: Synthetic polypeptide
QVQLVESGGGLVQPGESLRLSCVASASTFSTSLMGWVRQAPGKGLESVAEVRTTGGTFYAKSVAGRFTISRDNAKNTLYLQMNSLKAEDTGVYYCTAGAGPIATRYRGQGTQVTVSSAHHSEDP

SEQ ID NO: 3897 - protein, 137 aa, Artificial Sequence
  Description of Artificial Sequence: Synthetic polypeptide
QVQLVESGGGLVQPGGSLKLSCAASGFTLADYVTVWFRQAPGKSREGVSCISSSRGTPNYADSVKGRATVSRNNANNTVYLQMNGLKPDDTAIYYCAAIRPARLRAYRECLSSQAEYDYWGQGTQVTVSSAHHSEDP

SEQ ID NO: 3898 - protein, 134 aa, Artificial Sequence
  Description of Artificial Sequence: Synthetic polypeptide
QVQLVESGGGLVQPGGSLGLSCAMSGTTQDYSAVGWFRQAPGKEREGVSCISRSGRRTNYADSVRGRFTISRDNAKDTVYLWINSLKPDDTAVYYCAARKTDMSDPYYVGCNGMDYWGKGTLVTVSSAHHSEDP

SEQ ID NO: 3899 - protein, 130 aa, Artificial Sequence
  Description of Artificial Sequence: Synthetic polypeptide
QVQLVESGGGLVQPGGSLTLSCTASGFTLNSYKIGWFRQAPGKEREGVSCINSGGNLRSVEGRFTISRDNTKNTVSLHMDSLKPEDTGVYHCAAAPALNVFSPCVLAPRYDYWGQGTQVTVSSAHHSEDP

SEQ ID NO: 3900 - protein, 134 aa, Artificial Sequence
  Description of Artificial Sequence: Synthetic polypeptide
QVQLVESGGGLVQPGGSLRLSCAASGFTLGSYHIGWFRHPPGKEREGTSCLSSRGDYTKYAEAVKGRFTISRDNTKSTVYLQMNNLKPEDTGIYVCAAIRPVLSDSHCTLAARYNYWGQGTQVTVSSAHHSEDP

SEQ ID NO: 3901 - protein, 133 aa, Artificial Sequence
  Description of Artificial Sequence: Synthetic polypeptide
QVQLVESGGGLVQPGGSLRLSCAALEFTLEDYAIAWFRQAPGKEREGVSCISKSGVTKYTDSVKGRFTVARDNAKSTVILQMNNLRPEDTAVYNCAAVRPVFVDSVCTLATRYTYWGEGTQVTVSSAHHSEDP

SEQ ID NO: 3902 - protein, 134 aa, Artificial Sequence
  Description of Artificial Sequence: Synthetic polypeptide
QVQLVETGGGLVQPGGSLKLSCAASEFTLDDYHIGWFRQAPGKEREGVSCINKRGDYINYKDSVKGRFTISRDGAKSTVFLQMNNLRPEDTAVYYCAAVNPVFPDSRCTLATRYTHWGQGTQVTVSSAHHSEDP

SEQ ID NO: 3903 - protein, 113 aa, Artificial Sequence; identical to SEQ ID NO: 3851
  Description of Artificial Sequence: Synthetic polypeptide

SEQ ID NO: 3904 - protein, 122 aa, Artificial Sequence; identical to SEQ ID NO: 3848
  Description of Artificial Sequence: Synthetic polypeptide

SEQ ID NO: 3905 - protein, 129 aa, Artificial Sequence; identical to SEQ ID NO: 3893
  Description of Artificial Sequence: Synthetic polypeptide

SEQ ID NO: 3906 - protein, 132 aa, Artificial Sequence; identical to SEQ ID NO: 3894
  Description of Artificial Sequence: Synthetic polypeptide

SEQ ID NO: 3907 - protein, 134 aa, Artificial Sequence; identical to SEQ ID NO: 3900
  Description of Artificial Sequence: Synthetic polypeptide

SEQ ID NO: 3908 - protein, 133 aa, Artificial Sequence; identical to SEQ ID NO: 3901
  Description of Artificial Sequence: Synthetic polypeptide

SEQ ID NO: 3909 - protein, 134 aa, Artificial Sequence; identical to SEQ ID NO: 3902
  Description of Artificial Sequence: Synthetic polypeptide

SEQ ID NO: 3910 - protein, 132 aa, Artificial Sequence; identical to SEQ ID NO: 3895
  Description of Artificial Sequence: Synthetic polypeptide

SEQ ID NO: 3911 - protein, 124 aa, Artificial Sequence; identical to SEQ ID NO: 3896
  Description of Artificial Sequence: Synthetic polypeptide

SEQ ID NO: 3912 - protein, 137 aa, Artificial Sequence; identical to SEQ ID NO: 3897
  Description of Artificial Sequence: Synthetic polypeptide

SEQ ID NO: 3913 - protein, 134 aa, Artificial Sequence
  Description of Artificial Sequence: Synthetic polypeptide
QVQLVESGGGLVQPGGSLGLSCAMSGTTQDYSAVGWFRQAPGKEREGVSCISRSGRRTNYADSVRGRFTISRDNAKDTVYLQMNSLKPDDTAVYYCAARKTDMSDPYYVGCNGMDYWGKGTLVTVSSAHHSEDP

SEQ ID NO: 3914 - protein, 130 aa, Artificial Sequence; identical to SEQ ID NO: 3899
  Description of Artificial Sequence: Synthetic polypeptide

SEQ ID NO: 3915 - protein, 128 aa, Artificial Sequence
  Description of Artificial Sequence: Synthetic polypeptide
VQLEESGAEVKKPGASVKVSCKASRYTFTNYYMHWVRQAPGQGLEWMGIINPSGGSTSYAQKFQGRVTMTRDTSTSTVYMELSSLRSEDTAMYYCARDLGHKYVGGRFLEINNWFNPWGQGTTVTVSS

SEQ ID NO: 3916 - protein, 119 aa, Artificial Sequence
  Description of Artificial Sequence: Synthetic polypeptide
MAKISWWQSGGEVKKPGESLKISCKGSGYIFASHWIGWVRQMPGKGLEWIGFIFPGDSDTRYSPSFQGQVTISADKSINTAYLQWTTLEASDTAMYYCARRGSSYDAFDIWGQGTMVTV

SEQ ID NO: 3917 - protein, 113 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNSKNTLYLQMSSLRAEDTAVYYCVKGASSWSTGTLVTVSS

SEQ ID NO: 3918 - protein, 118 aa, Artificial Sequence
  Description of Artificial Sequence: Synthetic polypeptide
QIQLVQSGPELKKPGETVKISCKASGYTFTNYGINWVKQAPGKGLKWMGWINTITEEPTFAEEFTGRFAFSLETSASTAYLQINNLKNEDTATYFCARGSEFGRLVYWGQGASVTVSS

SEQ ID NO: 3919 - protein, 114 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNSKNTLYLQMSSLRAEDTAVYYCVKGASSWSTGTLVTVSSA

SEQ ID NO: 3920 - protein, 121 aa, Artificial Sequence
  Description of Artificial Sequence: Synthetic polypeptide
QVQLQESGGGLVKPGGSLKLSCAASGFTFSSYGMSWVRQTPDKRLEWVATISSGGSYTYYPDSVKGRFTISRDNAKNTLYLQMSSLKSEDTAMYYCARLYYGYRYYFDYWGQGTMVTVSSA

SEQ ID NO: 3921 - protein, 125 aa, Artificial Sequence
  Description of Artificial Sequence: Synthetic polypeptide
QVQLVQSGGGVVQPGRSLRLSCAASGFTFSSYAMHWVRQAPGKGLEWVAVISYDGSNKYYADSVKGRFTISRDNSKNTLYLQMNSLRAEDKAVYYCARDSGGIAARLGGYFDLWGRGTTVTVSSA

SEQ ID NO: 3922 - protein, 108 aa, Artificial Sequence
  Description of Artificial Sequence: Synthetic polypeptide
EIVLTQSPDILSLSPGERATLSCRASQALTAKYLAWYQQKPGQVPRLLIYGSSTRATGIPDRFRGSGSGTDFTLTISRLEPADSAVYYCQQYEDSPWTFGQGTKLEIK

SEQ ID NO: 3923 - protein, 151 aa, Artificial Sequence
  Description of Artificial Sequence: Synthetic polypeptide
MKSQTQVFVFLLLCVSGAHGSIVMTQTPKFLLVSAGDRVTITCKASQSVTNDVTWYQQKPGQSPKLLIYYASNRYTGVPDRFTGSGYGTDFTFTISTVQAEDLAVYFCQQDYSSPFTFGSGTKLEIKRADAAPTVSIFPPSSEQLSNSCSP

SEQ ID NO: 3924 - protein, 122 aa, Artificial Sequence
  Description of Artificial Sequence: Synthetic polypeptide
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSS

SEQ ID NO: 3925 - protein, 115 aa, Artificial Sequence
  Description of Artificial Sequence: Synthetic polypeptide
EVQLVESGGGLVQPGGSLRLSCEAFGFSFSRYWMHWVRQAPGKGLVWVARMSRDGSTVSYADSVKGRFTVSRDNAKNTLFLQMNSLTADDTAVYYCVSQIFLGYWGQGTLVTVSS

SEQ ID NO: 3926 - protein, 122 aa, Artificial Sequence
  Description of Artificial Sequence: Synthetic polypeptide
EVQLVESGGGLVQPGRSLRLSCTASGFNFDDYAMSWFRQAPGKGLEWVGYIRNKAYGGTTEYAASMRGRFTISRDDSKTIAYLQINSLKTEDTAIYYCTREGTAMVHTFDIWGQGTMVTVSS

SEQ ID NO: 3927 - protein, 120 aa, Artificial Sequence
  Description of Artificial Sequence: Synthetic polypeptide
QVQLVESGGGLVKPGGSLRLSCAASGFDFTDYYMNWIRQVPGKGLEWVASISSSAGTIYYADSVKGRFTISRDNAKRSLFLQMYSLRAEDMAVYYCARDQDRWNYPFDHWGQGTLVTVSS

SEQ ID NO: 3928 - protein, 118 aa, Artificial Sequence
  Description of Artificial Sequence: Synthetic polypeptide
QVQLVQSGPEVKKPGASVKVSCKAAGYMFTTYGISWVRRAPGQGLEWMGWIRTYNGDTNYALKVQDRVTMTTDTSTNTAYMDLRSLRSDDTAVYYCARGRVAAGFDYWGQGTTVTVSS

SEQ ID NO: 3929 - protein, 124 aa, Artificial Sequence
  Description of Artificial Sequence: Synthetic polypeptide
QVQLQESGPGLVKPSQTLSLTCNVSESISSSDYYWAWIRQPPGKGLEWLGQIYYRGTTYYNPSLKSRVSISVDTSKDQFSLNLMSVTAADTAVYYCARRSFSDIFTGVNSFDVWGQGTMVTVSS

SEQ ID NO: 3930 - protein, 120 aa, Artificial Sequence
  Description of Artificial Sequence: Synthetic polypeptide
EVQLVESGGGWRPGGSLRLSCAASGFIFDEYGLNWVRQAPGKGLEWISVINWSGDNTAYADSVKGRFNISRDNAKNSLYLYMSDLRVGDTALYFCTRGGDYDRGDTIDFWGRGTMVTVSS

SEQ ID NO: 3931 - protein, 121 aa, Artificial Sequence
  Description of Artificial Sequence: Synthetic polypeptide
EVQLVESGGGWQPGGSLRLSCTTSGFIFRNYFMHWVRHIPGKGPEWVARIQSDGAFTKYAESAQGRFEISRDNVKNILYLQMNSLRVEDSAIYYCARGLVPLAPGRAFDLWGQGTMVTVSS

SEQ ID NO: 3932 - protein, 116 aa, Artificial Sequence
  Description of Artificial Sequence: Synthetic polypeptide
EVQLVESGAEVKKPGESLRISCKASKDAFPNYWIAWVRHIPGKGLEWMGLIYPRDSDTRYSPSFQGQVTFSVDKSITTAYLQWSSLKASDTAIYYCAIGQFRFAPWGQGTLVTVSS

SEQ ID NO: 3933 - protein, 118 aa, Artificial Sequence
  Description of Artificial Sequence: Synthetic polypeptide
QVQLVESGPGLVKPSETLSLTCTVSGDSMRSHYWSWIRQPPGKGLEWIGSIYFDGRTDYNPSLYNRVAISVDTSKNQFSLKLRFVTAADTAVYYCARIGGSREGFQHWGHGTLVTVFS

SEQ ID NO: 3934 - protein, 122 aa, Artificial Sequence
  Description of Artificial Sequence: Synthetic polypeptide
EVQLVESGGGWRPGGSLRLSCAASGFKFDDYGMSWVRQVPGKGPEWVSGTNWNGGRTAYADFVLGRFTISRDNARNSLYLQMNSLSGDDTAIYYCARVPLSNGWHLSYFDYWGQGSPVIVSS

SEQ ID NO: 3935 - protein, 123 aa, Artificial Sequence
  Description of Artificial Sequence: Synthetic polypeptide
EVQLVESGGGLAQSGGSLRLSCVASGVTFVYSAMNWVRQAPGRGLEWVSTISAAGDNTFYADSLKGRFTISRDNSKNMLYLQMNSLRVDDTALYFCARELRRHYYDLRAFDIWGQGTMVTVSS

SEQ ID NO: 3936 - protein, 122 aa, Artificial Sequence
  Description of Artificial Sequence: Synthetic polypeptide
QVQLRESGPRLVKPLEILSLTCTVFGVNIGSYYGTRIPHTAGKGLEWIGRIFIRKGTNYSPYLQSRVTMSKDTSKKQISLKLTSVTAADTAVYYCAKALHTARGLEDAFDVWGKGTMVTVSS

SEQ ID NO: 3937 - protein, 124 aa, Artificial Sequence
  Description of Artificial Sequence: Synthetic polypeptide
QVQLQQWGAGLLKPSETLSLTCAVYGGSFSGYYWSWIRQPPGKNLEWIGEINDSGSTNYNPSLKSRVTISVDTSKNQFSLKLSSVTAADTAVYYCARDVLRYFDWLSERGLDYWGQGTLVTVSS

SEQ ID NO: 3938 - protein, 120 aa, Artificial Sequence
  Description of Artificial Sequence: Synthetic polypeptide
QVRLVKSGAEVKKPGSSVKVSCKASGGTFRSYTINRVLQAPGQGLEWMGRIIPFLCMSNSAQRFQDRVTMTADESTSTAHKELCCLRFEDTAVYYCARGWGDGYKGALDCWGQGTLVSVS

SEQ ID NO: 3939 - protein, 122 aa, Artificial Sequence
  Description of Artificial Sequence: Synthetic polypeptide
QVQLVESGGGSVKPGGSLRLSCSTSGFMFSYYYMSWFRQAPGKGLEWISYICGHGDHIYYADSVKGRFTISRDNATESLHLQMNNLKVEDTAIYYCAREGESDVLTGPYAFWGQGNTVTVSS

SEQ ID NO: 3940 - protein, 215 aa, Artificial Sequence
  Description of Artificial Sequence: Synthetic polypeptide
VQLQQSGPELVKPGTSVKISCKTSGYTFTENTMHWVKQSHGESLDWVGGINTDNGGTTYSQKFKGKATLTVDKSSSTAYMELRSLTSEDSAVYYCSTGYDAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPR

SEQ ID NO: 3941 - protein, 233 aa, Artificial Sequence
  Description of Artificial Sequence: Synthetic polypeptide
EVQLQQSGAELVKPGASVKLSCTASGFNIKDNYMHWVKQRPEQGLEWIGRIDPANGNTKYDPKFQGKATITADTSSNTAYLQLSSLTSEDTAVYYCARHYDGYFLYYFEYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVP

SEQ ID NO: 3942 - protein, 119 aa, Artificial Sequence
  Description of Artificial Sequence: Synthetic polypeptide
MAQMQLVQSGGEVKKPGESLKISCKGSGYIFASHWIGWVRQMPGKGLEWIGFIFPGDSDTRYSPSFQGQVTISADKSINTAYLQWTTLEASDTAMYYCARRGSSYDAFDIWGQGTMVTV

SEQ ID NO: 3943 - protein, 110 aa, Artificial Sequence
  Description of Artificial Sequence: Synthetic polypeptide
ALDIVMTQSPSSVSASVGDRVTITCRASQGIRSWLAWYQQKPGKAPKLLISAASSLQSGVPSRFSGSGSGTDFTLTVSSLQPEDFATYYCQQANSFPLTFGGGTKVEIKR

SEQ ID NO: 3944 - protein, 107 aa, Artificial Sequence
  Description of Artificial Sequence: Synthetic polypeptide
DIELTQSPSSVSASVGDRVTITCRASQAIASYLAWYQQRPGRAPRLLIYDVSNLQSGVPSRFSGSGSGTDFTLTISSLQGEDFASYYCQQSYSTPYSFGQGTKVKSN

SEQ ID NO: 3945 - protein, 108 aa, Artificial Sequence
  Description of Artificial Sequence: Synthetic polypeptide
DIVMMQSPATLSASVGDRVTITCRASQSISSWLAWYQQKPGKAPNLLIYKASSLESGVPSRFSGSGSGTEFTLTISSLQPDDFATYYCQQYKSFPYTFGQGTRLEIKR

SEQ ID NO: 3946 - protein, 108 aa, Artificial Sequence
  Description of Artificial Sequence: Synthetic polypeptide
DIQMTQTTSSLSASLGDRVTISCSASQGISNYLNWYQQKPDGTVKLLIFYTSTLYSGVPSRFSGSGSGTDYSLTISNLEPEDIATYYCQQYSRFPYVFGGGTKLEIKR

SEQ ID NO: 3947 - protein, 108 aa, Artificial Sequence; identical to SEQ ID NO: 3945
  Description of Artificial Sequence: Synthetic polypeptide

SEQ ID NO: 3948 - protein, 108 aa, Artificial Sequence
  Description of Artificial Sequence: Synthetic polypeptide
DIQLTQSPSSLSASIGDRVTITCQASQDITNSLNWYQQRPGQAPKLLIYDAFTLKTGVPSRFSGRGSGTSFTIAINSFQAEDIGTYFCQQSHRVPFTFGGGTRVEIKR

SEQ ID NO: 3949 - protein, 104 aa, Artificial Sequence
  Description of Artificial Sequence: Synthetic polypeptide
DIRMTQSPSFLSASVGDRVTITCRASQGISSYLAWYQQKPGKAPKLLIYAASTLQSGVPSRFSGSGSGTEFTLTISSLQPEDFATYYCQQGPTFGGGTKVEIKR

SEQ ID NO: 3950 - protein, 127 aa, Artificial Sequence
  Description of Artificial Sequence: Synthetic polypeptide
EVQLVESGGDLVKPGGSLRLSCVVSGFRISTSAMSWVRQVPGKGLEWVSDISESGGSKDYADSVRGRFTISRDTSKNTLYLQMNSLGADDTALYYCAKSVGYFDTSGYYRWDYFDSWGQGTLVTVSS

SEQ ID NO: 3951 - protein, 108 aa, Artificial Sequence
  Description of Artificial Sequence: Synthetic polypeptide
EIVLTQSPDTLSLSPGETATLSCRASQTVRRNSLAWYQQKPGQAPRLLIYGASDRATGIPDRFSGSGFGTDFTLTVSGLEPEDFAVYYCQQYGTSPRTFGQGTKLEIK

SEQ ID NO: 3952 - protein, 179 aa, Artificial Sequence
  Description of Artificial Sequence: Synthetic polypeptide
MEWIWIFLFILSGTAGVQSQVHLQQSGGEVARPGASVKLSCKASGYTFTGYGLSWVKQRTGQGLEWIGEIYPRSGNTYYNEKFKGKATLTADKSSSTAYMELRSLTSEDSAVYFCARSWGNSSFVYWGQGTLVTVSAAKTTPPSVYPLAPGSAAQTNSMVTLGCLVKGYFPEPVTVTWN

SEQ ID NO: 3953 - protein, 107 aa, Artificial Sequence
  Description of Artificial Sequence: Synthetic polypeptide
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIK

SEQ ID NO: 3954 - protein, 108 aa, Artificial Sequence
  Description of Artificial Sequence: Synthetic polypeptide
EIVLTQSPGTLSLSPGDRTTLSCRASQNVGRDFVAWYQQRPGQTPRLLIYAASDRATGIPDRFSGNGSGTDFTLTINSLEPEDFALYYCLQYGSSPHSFGQGTKLEIK

SEQ ID NO: 3955 - protein, 110 aa, Artificial Sequence
  Description of Artificial Sequence: Synthetic polypeptide
QLVLTQPASVSGSPGQSITISCTGTSSDIGGYKYVSWYQKHPGKAPKLMIFDVSNRPSGVSNRFSGSKSGNTASLTISGLQAEDEADYYCSSYTSSSSLVFGLGTRVTVL

SEQ ID NO: 3956 - protein, 106 aa, Artificial Sequence
  Description of Artificial Sequence: Synthetic polypeptide
EIVMTQSPATLSVSPGERATLSCRASQSVGSNLAWYQQKPGQAPRLLIYGASTRAAGIPARFSGSGSGTEFTLTISSLQSEDFAVYLCQQYNTWPTFGQGTKVEIK

SEQ ID NO: 3957 - protein, 110 aa, Artificial Sequence
  Description of Artificial Sequence: Synthetic polypeptide
QSVLTQSPSASGTPGQWVSISCSGSNSNIGTNTVNWYQQLPETAPKLLIYSNNQRPSGVPDRFSGSKSGTSASLAISGLQSEDEADYYCAVWDDSLNGPVFGGGTKLTVL

SEQ ID NO: 3958 - protein, 111 aa, Artificial Sequence
  Description of Artificial Sequence: Synthetic polypeptide
DIVMTQTPLSSPVTLGQPASISCRSSQSLEHSDENTYLSWFLQRPGQPPRLLIYKISHRFSGVPDRFSGSGAGTDFTLKISRVEAEDAGVYYCMQAKQFPWTFGQGTKVEI

SEQ ID NO: 3959 - protein, 113 aa, Artificial Sequence
  Description of Artificial Sequence: Synthetic polypeptide
DIVMTQSPDSLAVSLGDRATINCRSNQTLFYRSHNKNYLAWYQQRPPQPPKLIFYGASTRESGVPDRFSGSGSGTDFTLTITGLQTEDVAVYYCQQYYSNPITFGQGTRLEIK

SEQ ID NO: 3960 - protein, 108 aa, Artificial Sequence
  Description of Artificial Sequence: Synthetic polypeptide
EIVLTQSPDTLSLSPGERATLSCRANQSVTTDYLAWYKVKFGQAPRLLIYHTSRRAIGIPDRFSGSGSGTDFTLTISRLEPDDFVLYYCQQYENSPGTFGQGTKVEIK

SEQ ID NO: 3961 - protein, 104 aa, Artificial Sequence
  Description of Artificial Sequence: Synthetic polypeptide
DIQMTQSPSSLSASWGRVTIICQASQDIGNYLNWYQQKPGKAPKLLISDASNLQTGVPSRFSGSGSGADFTFTISSLQPQDVATYYCQQSHIVPVTFGPGTEVE

SEQ ID NO: 3962 - protein, 107 aa, Artificial Sequence
  Description of Artificial Sequence: Synthetic polypeptide
SYVLTQAPSVSVAPGQTASISCGGNNIGSKSVQWYRQTPGQAPVLWSDDSDRPSGIPERFSGSNSGNTATLTITRVEAGDEADYYCQVWDTTTDHVVFGGGTKLTVL

SEQ ID NO: 3963 - protein, 108 aa, Artificial Sequence
  Description of Artificial Sequence: Synthetic polypeptide
EIVLTQSPGTLSLSPGDRATLSCRTSQSLASINLAWYRQKPGQAPRLLIYDTSTRATGIPDRFSGSGSGTDFTLTISRLEPEDFAVYYCQQYGTLPRTFGPGTKVDIK

SEQ ID NO: 3964 - protein, 109 aa, Artificial Sequence
  Description of Artificial Sequence: Synthetic polypeptide
QAWTQSPSASGTPGQRVTISCSGTTSNIGSNSVSWYRQFPGTTPKLLIYTNNQRSSGVPGRFSGSKSGTSASLAISGLQSEDEADYFCASWDDSLNGHVFGGGTKLTVL

SEQ ID NO: 3965 - protein, 113 aa, Artificial Sequence
  Description of Artificial Sequence: Synthetic polypeptide
DIVMTQSPDSLAVSLGERATISCRSSQPLLFKSNNKNYLAWYQHKPGQPPRLLVYWASTRESGVPDRFSGSGSGTDFNLTISNLQAEDVAVYYCQQYYTTSYAFGQGTKLEIK

SEQ ID NO: 3966 - protein, 109 aa, Artificial Sequence
  Description of Artificial Sequence: Synthetic polypeptide
SMLTQPPSASGTPGQRVTISCSGSGSNIGSNYVYWFQQLPGTAPKLLIYRNNQRPSGVPDRFSGSKSGTSASLAISGLRSEDEADYYCAAWDDSLSVWVFGGGTKLTVL

SEQ ID NO: 3967 - protein, 112 aa, Artificial Sequence
  Description of Artificial Sequence: Synthetic polypeptide
NFMVTQPHSVSESPGKTVTISCTRSSGSIASNYVQWYQQRPGSSPTTVIYEDDQRPSGVPDRFSGSIDSSSNSASLTISGLKTEDEADYYCQSYDASNHLWVFGGGTKLTVL

SEQ ID NO: 3968 - protein, 110 aa, Artificial Sequence
  Description of Artificial Sequence: Synthetic polypeptide
QSVLTQSPSASASLGASVKLTCTLSSGHSSYAIAWHQQQPEKGPRYLMKLNSDGSHSKGDGIPDRFSGSSSGAERYLTISSLQSEDEADYYCQTWGTGIWFGGGTKLTVL

SEQ ID NO: 3969 - protein, 214 aa, Artificial Sequence
  Description of Artificial Sequence: Synthetic polypeptide
NIVLTQSPASLAVSLGQRATISCRASKGVDSYGNSFMHWYQQRPGQPPKLLIYLASHLESGVPARFSGSGSRTDFTLTIDPVEADDAATYYCQQNNEDPFTFGSGTKLEIKRADAAPTVSIFPPSSEQLTPGGASVVCFLNNFYPKDINVKWKIDGSERQNGVLNSWTDQDSKDSTYSMSSTLTLTKDEYERHNSYTCEATHKKGEFQHTGGRY

SEQ ID NO: 3970 - protein, 234 aa, Artificial Sequence
  Description of Artificial Sequence: Synthetic polypeptide
LSLDMMSSAQFLGLLLLCFQGTRCDIQMTQTTSSLSASLGDRVTITCRAGQDISNYLNWYQQKPDGTVKLLIYYTSRLHSGVPSRFSGSGSGTDYSLTISNLEQEDIATYFCQQGSTFPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKKGEFQHTGGRY

SEQ ID NO: 3971 - protein, 213 aa, Artificial Sequence
  Description of Artificial Sequence: Synthetic polypeptide
  MOD_RES (1)..(1): Any amino acid
XSVLSQSPAILSASPGEKVTMTCRARSSVSYMHWYQQKSGSSPKPWIHATSNLASGVPARFSGSGSGTSYSLTISRVEAEDAATYYCQQWSSHPPTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 3972 - protein, 212 aa, Artificial Sequence
  Description of Artificial Sequence: Synthetic polypeptide
DIVMTQSHKFMSTSVGDRVTITCKASQDVTTAVAWYQQKPGHSPKLLIYWASTRHTGVPDRFTGSGSGTAFTLTLNSVQAEDLALYYCQQHYSTPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRN

SEQ ID NO: 3973 - protein, 220 aa, Artificial Sequence
  Description of Artificial Sequence: Synthetic polypeptide
EVQLVESGGGLVTPGGSLKLSCAASGFAFNYYDMFWVRQNTEKRLEWVAYINSGGGNTYYPDTVKGRFTISRDNAKKTLFLQMSSLRSEDTAMYYCARQLYGNSFFDYWGQGTSLTVSAAKTTPPSVYPLAPGSAAAAASMVTLGCLVKGYFPEPVTVTWNSGSLSSGVHTFPAVLQSDLYTLSSSVTVPSSPRPSETVTCNVAHPASSTKVDKKIVPRD

SEQ ID NO: 3974 - protein, 218 aa, Artificial Sequence
  Description of Artificial Sequence: Synthetic polypeptide
QLVLTQSSSASFSLGASAKLTCTLSRQHSTYTIEWYQQQPLKPPRYVMELKKDGSHSTGDGIPDRFSGSSSGADRYLSISNIQPEDEAIYICGVGDTIKEQFVYVFGGGTKVTVLGQPKSTPTLTVFPPSSEELKENKATLVCLISNFSPSGVTVAWKANGTPITQGVDTSNPTKEGNKFMASSFLHLTSDQWRSHNSFTCQVTHEGDTVEKSLSPAE

SEQ ID NO: 3975 - protein, 222 aa, Artificial Sequence
  Description of Artificial Sequence: Synthetic polypeptide
EVQVVESGGGLVKPGGSLKLSCAASGFAFSSYDMSWVRQTPEKRLEWVAYISRGGGYTYYPDTVKGRFTISRDNAKNTLYLQMSSLKSEDTAMYYCSRHIYYGSSHYYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEP

SEQ ID NO: 3976 - protein, 226 aa, Artificial Sequence
  Description of Artificial Sequence: Synthetic polypeptide
QLQLQESGPGLVKPSETLSLTCTVSGGSISSSSYYWGWIRQPPGKGLEWIGSVYYSGGASYNPSLKSRATISVDTSKNQFSLNLDSVSAADTAIYYCASIYGSGTFYYYFYMDVWGKGSTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 3977 - protein, 211 aa, Artificial Sequence
  Description of Artificial Sequence: Synthetic polypeptide
DIQMTQSPSSLSASVGDRVTITCQASQVISNYLNWYQQKPGKAPKLLIYDTSNLKTGVPSRFSGSGSGTDFTFTISSLQPEDIATYYCQQYENLQFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNR

SEQ ID NO: 3978 - protein, 861 aa, Artificial Sequence
  Description of Artificial Sequence: Synthetic polypeptide
MGVTGILQLPRDRFKRTSFFLWVIILFQRTFSIPLGVIHNSTLQVSDVDKLVCRDKLSSTNQLRSVGLNLEGNGVATDVPSATKRWGFRSGVPPKVVNYEAGEWAENCYNLEIKKPDGSECLPAAPDGIRGFPRCRYVHKVSGTGPCAGDFAFHKEGAFFLYDRLASTVIYRGTTFAEGVVAFLILPQAKKDFFSSHPLREPVNATEDPSSGYYSTTIRYQATGFGTNETEYLFEVDNLTYVQLESRFTPQFLLQLNETIYTSGKRSNTTGKLIWKVNPEIDTTIGEWAFWETKKNLTRKIRSEELSFTVVSNGAKNISGQSPARTSSDPGTNTTTEDHKIMASENSSAMVQVHSQGREAAVSHLTTLATISTSPQSLTTKPGPDNSTHNTPVYKLDISEATQVEQHHRRTDNDSTASDTPSATTAAGPPKAENTNTSKSTDFLDPATTTSPQNHSETAGNNNTHHQDTGEESASSGKLGLITNTIAGVAGLITGGRRTRREAIVNAQPKCNPNLHYWTTQDEGAAIGLAWIPYFGPAAEGIYIEGLMHNQDGLICGLRQLANETTQALQLFLRATTELRTFSILNRKAIDFLLQRWGGTCHILGPDCCIEPHDWTKNITDKIDQIIHDFVDKTLPDGTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 3979 - protein, 213 aa, Artificial Sequence
  Description of Artificial Sequence: Synthetic polypeptide
QVQLQQSGPELVKPGASVKMSCKASGYTFTDYVISWVKQRTGQGLEWIGEFYPGTDSTYYTENFKGRATLTADKSSKTAYMQLSSLTSEDSAVYFCATAFDYWGQGTTLTVSSAATTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPR

SEQ ID NO: 3980 - protein, 46 aa, Artificial Sequence
  Description of Artificial Sequence: Synthetic polypeptide
EVQLVESGGGLVQPGGSLRLSCAASGFAFNYYDIHWVRQAPGKGLE

SEQ ID NO: 3981 - protein, 46 aa, Artificial Sequence
  Description of Artificial Sequence: Synthetic polypeptide
EVQLVESGGGLVQPGGSLRLSCAASGFAFNYYDLHWVRQAPGKGLE

SEQ ID NO: 3982 - protein, 46 aa, Artificial Sequence
  Description of Artificial Sequence: Synthetic polypeptide
EVQLVESGGGLVQPGGSLRLSCAASGFAFNYYDMHWVRQAPGKGLE

SEQ ID NO: 3983 - protein, 46 aa, Artificial Sequence
  Description of Artificial Sequence: Synthetic polypeptide
WVAYINPGGGNTYYADSVKGRFTISADTSKNTAYLQMNSLRAEDTA

SEQ ID NO: 3984 - protein, 25 aa, Artificial Sequence
  Description of Artificial Sequence: Synthetic peptide
VYYCARQLYGNSFMDYWGQGTLVTV

SEQ ID NO: 3985 - protein, 25 aa, Artificial Sequence
  Description of Artificial Sequence: Synthetic peptide
VYYCARQLYGNSFFDYWGQGTLVTV

SEQ ID NO: 3986 - protein, 120 aa, Artificial Sequence
  Description of Artificial Sequence: Synthetic polypeptide
ERQLVESGGGVVKPGESLKLSCAASGFAFSSYDMSWVRQTPEKRLEWVAYSSRGGGFTYYPDTVKGRFTIARDNAKNTLHLQMSSLKSEDTAMYYCATHYYGPLYAMDYWGQGTSVTVSS

SEQ ID NO: 3987 - protein, 119 aa, Artificial Sequence
  Description of Artificial Sequence: Synthetic polypeptide
QVTLKESGPGILQPSQTLSLTCSFSGFSLSTSGMSVGWFRQPSGKGLEWLAHIWWTDDKYYNPALKSRLTISKDTSNNQVFLKIASVVTAESATYYCARIGYDGPPDYWGQGTIFTVSS

SEQ ID NO: 3988 - protein, 121 aa, Artificial Sequence
  Description of Artificial Sequence: Synthetic polypeptide
EVQLQQSGPELVKPGASVKMSCKASGYTFTSYVMHWVKQKPGQGLEWIGYINPYNDGPKYNEKFKGKATLTSDKSSRTAYMELSSLTTEDSAVFYCARGRGDAYFYVLDYWGQGTSVTVSS

SEQ ID NO: 3989 - protein, 150 aa, Artificial Sequence
  Description of Artificial Sequence: Synthetic polypeptide
WSWVILFLFSVTAGVHSQVQLQQSGAELAKPGASVKMSCKASGYTFTSYWMHWVKQRPGQGLEWIGYINPSTGYTEYNQKFKDKATLTADKSSTTAYMQLSSLTSEDSAVYYCARSGAYYYGSSPYFDYWGQGTTLTVSSAKTTPPSVYP

SEQ ID NO: 3990 - protein, 150 aa, Artificial Sequence
  Description of Artificial Sequence: Synthetic polypeptide
EFMEWSWVILFLLSVTAGVHSQVQLQQSGAELMKPGASVKISCKATGYTFSSYWIEWVKQRPGHGLEWIGEILPGSGSTNYNEKFKGKATFTADTSSNTAYMQLSSLTSEDSAVYYCARNYAYWGQGTLVTVSAAKTTPPSVYPLAPGSL

SEQ ID NO: 3991 - protein, 142 aa, Artificial Sequence
  Description of Artificial Sequence: Synthetic polypeptide
  MOD_RES (77)..(77): Any amino acid
VVPGILSDVQLQESGPGLVKPSQTVSLTCTVTGISITAGNYRWSWIREFPGNKLEWIGNIYYSGTIAYNPSLTSRTXITRDSSKNQFFLEMNSLTAEDTATYYCARDRGWLLLDYWGQGTTLTVSSEKQQPHPFIHWPLEAW

SEQ ID NO: 3992 - protein, 157 aa, Artificial Sequence
  Description of Artificial Sequence: Synthetic polypeptide
  MOD_RES (149)..(149): Any amino acid
  MOD_RES (151)..(151): Any amino acid
  MOD_RES (153)..(153): Any amino acid
LVDMDSRLNLVFLVLTLKGVKCEVQLVESGGGLVTPGGSLKLSCAASGFAFNYYDMFWVRQNTEKRLEWVAYINSGGGNTYYPDTVKGRFTISRDNAKKTLFLQMSSLRSEDTAMYYCARQLYGNSFFDYWGQGTSLTVSAAKTTPPSXYXLXPGSL

SEQ ID NO: 3993 - protein, 150 aa, Artificial Sequence
  Description of Artificial Sequence: Synthetic polypeptide
MDFGLIFFIVALLKGVQCDVKLLESGGGLVQPGGSLKLSCAASGFDFSRYWMSWVRQAPGKGLEWIGEINPDSSTINYTPSLKDKFIISRDNAKNTLYLQMSKVRSEDTALYYCTRQGYGYNYWGQGTTLIVSSAKTTAPPVYPLVPGSL

SEQ ID NO: 3994 - protein, 158 aa, Artificial Sequence
  Description of Artificial Sequence: Synthetic polypeptide
MELGLSWIFLVLTLKGVKCEVQVVESGGGLVKPGGSLKLSCAASGFAFSSYDMSWVRQTPEKRLEWVAYISRGGGYTYYPDTVKGRFTISRDNAKNTLYLQMSSLKSEDTAMYYCSRHIYYGSSHYYAMDYWGQGTSVTVSSAKTTAPPVYPLAPGSL

SEQ ID NO: 3995 - protein, 157 aa, Artificial Sequence
  Description of Artificial Sequence: Synthetic polypeptide
  MOD_RES (19)..(19): Any amino acid
MGRLTSSFLLLIVPAYVLXQLTLKESGPGILKPSQTLSLTCSLSGFSLSTSGVGVGWFRQPSGKGLEWLALIWWDDDKYYNPSLKSQLSISKDFSRNQVFLKISNVDIADTATYYCARRDPFGYDNAMGYWGQGTSVTVSSAKTTAPPVYPLVPGSL

SEQ ID NO: 3996 - protein, 119 aa, Artificial Sequence
  Description of Artificial Sequence: Synthetic polypeptide
EVQLVESGGGLVQPKGSLKLSCAASGFAFNSYAMHWVCQAPGKGLEWVARIRIKSGNYATSYAGSVTDRFTVSRDDSQNLFYLQMNNLKTEDTAMYYCVREWEGAMDYWGQGTSVTVSS

SEQ ID NO: 3997 - protein, 116 aa, Artificial Sequence
  Description of Artificial Sequence: Synthetic polypeptide
QVQLQQSGTELVRPGTSVKISCKASGYDFTNFWLGWIKQRPGHGLEWIGDIYPGGDNTYYNEKFKGKVTLTADKSSNTAYMQFSSLTSEDSAVYFCFMILYTLDYWGQGTSVTVSS

SEQ ID NO: 3998 - protein, 119 aa, Artificial Sequence
  Description of Artificial Sequence: Synthetic polypeptide
DVQLVESGGGLVQPGGSRKLSCTASGFTFSSFGMHWVRQAPEKGLEWVAYISSGSSKIYYADTVKGRFTISRDNPKNTLFLQMTSLRSEDTAMYYCARGWYEGAWFAYWGQGTLVTVSA

SEQ ID NO: 3999 - protein, 114 aa, Artificial Sequence
  Description of Artificial Sequence: Synthetic polypeptide
EVQLQQSGPELVKPGASVKISCRTSGYTFTEYTIHWVKQSRGKSLEWIGGINPNHGGTLYNQKFKVKATLTVDKSSSTAYMELRSLTSEDSAVYYCARFTYDYWGQGTTLTVSS

SEQ ID NO: 4000 - protein, 116 aa, Artificial Sequence
  Description of Artificial Sequence: Synthetic polypeptide
QIQLVQSGPELKKPGETVKISCKASGYTFTNYGMNWVKQAPGKGLKWMGWINTYTGKPTYVDDFKGRFAFSLETSANTAYLQINNLKNEDTATYFCESGGYDEDYWGQGTTLTVSS

SEQ ID NO: 4001 - protein, 119 aa, Artificial Sequence
  Description of Artificial Sequence: Synthetic polypeptide
QVQLKESGPGLVAPSQSLSITCTVSGFSLTDYGITWIRQPPGKGLEWLGVIWGGGSAYYNLVLKSRLSISKDNSKSQVFLKMNSLQTDDTAMYYCAKHRTLITTAMDYWGQGISVTVSS

SEQ ID NO: 4002 - protein, 121 aa, Artificial Sequence
  Description of Artificial Sequence: Synthetic polypeptide
EVKLVESGGGLVKSGGSLKLSCAVSGFTFSTYAMSWVRQIPEKRLEWVATISNGGSYIYYSDSVKGRFTISRDNAKNTLYLQMSSLRSEDTAMYYCARHRESYRYDWFAYWGQGTLVTVSA

SEQ ID NO: 4003 - protein, 226 aa, Artificial Sequence
  Description of Artificial Sequence: Synthetic polypeptide
  MOD_RES (34)..(34): Any amino acid
  MOD_RES (83)..(83): Any amino acid
  MOD_RES (108)..(108): Any amino acid
  MOD_RES (120)..(120): Any amino acid
EVQLLESGGGLVKPGGSLRLSCAASGFTLINYRXNWVRQAPGKGLEWVSSISSSSSYIHYADSVKGRFTISRDNAENSLYLQXNSLRAEDTAVYYCVREGPRATGYSXADVFDIWGQGTXVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 4004 - protein, 144 aa, Artificial Sequence
  Description of Artificial Sequence: Synthetic polypeptide
EFMETQTQVFVFVFLWLSGVDGDIVMTQSHKFMSTSVGDRVTITCKASQDVTTAVAWYQQKPGHSPKLLIYWASTRHTGVPDRFTGSGSGTDFTLTLNSVQAEDLALYYCQQHYSTPLTFGAGTKLELKRADAAPTVSIFPPSS

SEQ ID NO: 4005 - protein, 149 aa, Artificial Sequence
  Description of Artificial Sequence: Synthetic polypeptide
MKLPVRLLVLMFWIPASSSDVLLTQIPLSLPVSLGDQASISCRSSQSIVHSNGNTYLEWYLQKPGQSPKLLIYKASNRFSGVPDRFSGSGSGTDFTLKINRVEAEDLGVYYCLQGSHVPSTFGGGTKLEIKRADAAPTVSIFPPSSKLG

SEQ ID NO: 4006 - protein, 238 aa, Artificial Sequence
  Description of Artificial Sequence: Synthetic polypeptide
  MOD_RES (5)..(5): Any amino acid
MAWIXLIFFVLHCSGSFSQLVLTQSSSASFSLGASAKLTCTLSRQHSTYTIEWYQQQPLKPPRYVMELKKDGSHSTGDGIPDRFSGSSSGADRYLSISNIQPEDEAIYICGVGDTIKEQFVYVFGGGTKVTVLGQPKSTPTLTVFPPSSEELKENKATLVCLISNFSPSGVTVAWKANGTPITQGVDTSNPTKEGNKFMASSFLHLTSDQWRSHNSFTCQVTHEGDTVEKSLSPAECL

SEQ ID NO: 4007 - protein, 145 aa, Artificial Sequence
  Description of Artificial Sequence: Synthetic polypeptide
MGIKMKSQTQAFVFAFLWLSGVDGDIVMTQSQKFMSTSVGDRVSLTCKASQNVGTAVAWYQQKPGQSPKLLIYSASNRYTGVPDRFTGSGSGTDFTLTISNMQSEDLADYFCQQYSSYPLTFGAGTKLELRRADAAPTVSIFPPS

SEQ ID NO: 4008 - protein, 112 aa, Artificial Sequence
  Description of Artificial Sequence: Synthetic polypeptide
DIVLTQSPLSLPVSLGDQASISCRSSQSLVHSNGNTYLHWYLQKPGQSPNLLIYKVSNRFSGVPDRFSGSGSGTDFTLKISRVEAEDLGVYFCSQSTHVPWTFGGGTKLEIK

SEQ ID NO: 4009 - protein, 112 aa, Artificial Sequence
  Description of Artificial Sequence: Synthetic polypeptide
DVVMTQTPLTLSVTIGQPASISCTSSQSLLNSDGETYLNWLLQRPGQSPKRLIHLVSKLDSGVPDRITGSGSGTDFTLKINRVEAEDLGIYYCWQGTHFPWTFGGGTKLEIK

SEQ ID NO: 4010 - protein, 112 aa, Artificial Sequence
  Description of Artificial Sequence: Synthetic polypeptide
DVLMTQTPLSLPVSLGDQASISCRSSQSIVHSNGDTYLEWYLQKPGQSPKLLIYKVSNRFSGVPDRFSGSGSGTDFTLRISRVEAEDLGVYYCFQGSHFPWTFGGGTKLEIK

SEQ ID NO: 4011 - protein, 111 aa, Artificial Sequence
  Description of Artificial Sequence: Synthetic polypeptide
DIVLTQSPASLAVSLGQRASISCKASQSVDHDGDSYMNWYQQKPGQPPKLLIYATSNLESGIPARFSGSGSGTDFTLNIHPVEEEDAATYYCQQSYEVPLTFGAGTKLELK

SEQ ID NO: 4012 - protein, 106 aa, Artificial Sequence
  Description of Artificial Sequence: Synthetic polypeptide
ENVLTQSPAIMSASPGEKVTMTCSASSSVTYMHWYQQKSSTSPKLWIYDTSKLASGVPGRFSGSGSGNSYSLTISSMEAEDVATYYCFQGSGYPYTFGGGTKLEIK

SEQ ID NO: 4013 - protein, 112 aa, Artificial Sequence
  Description of Artificial Sequence: Synthetic polypeptide
DVLMTQTPLSLPVSLGDQASISCRSSQNIVHSNGNTYLEWYLQKSGQSPKLLIYKVSNRFSGVPDRFSGSGSGTDFTLKISRVEAEDLGVYYCFQGSHFPWTFGGGTKLEIK

SEQ ID NO: 4014 - protein, 112 aa, Artificial Sequence
  Description of Artificial Sequence: Synthetic polypeptide
DVLMTQTPLSLPVSLGDQASISCRSSQNIVHSDGNTYLEWYLQKPGQSPKLLIYKFSNRFSGVPDRFSGSGSGTDFTLKISRVEAEDLGVYYCFQGSHVPPTFGAGTKLELK

SEQ ID NO: 4015 - protein, 115 aa, Artificial Sequence
  Description of Artificial Sequence: Synthetic polypeptide
QLVLTQSSSASFSLGASAKLTCTLSSQHSTFTIEWYQQQPLKAPKYVMELKKDGSHSTGDGIPDRFSGSSSGADRYLWISNIQPEDEAMYICGVGDTIKEQFVYVFGGGTKVTVL

SEQ ID NO: 4016 - protein, 107 aa, Artificial Sequence
  Description of Artificial Sequence: Synthetic polypeptide
EIVLTQSPALMAASPGEKVTITCSVSSSISSSNLHWYQQKSETSPKPWIYGTSNLASGVPDRFTGSGSGTDFTLTISSVQAEDLTLYYCHQYLSSWTFGGGTKLEIK

SEQ ID NO: 4017 - protein, 106 aa, Artificial Sequence
  Description of Artificial Sequence: Synthetic polypeptide
QIVLSQSPAILSASPGEKVTMTCRASSSVSYMHWYHQNPGSSPKPWIYATSNLASGVPARFSGSGSGTSYSLTISRVEAEDAATYYCQQWSSNPPTFGGGTKLAIK

SEQ ID NO: 4018 - protein, 217 aa, Artificial Sequence
  Description of Artificial Sequence: Synthetic polypeptide
  MOD_RES (4)..(4): Any amino acid
ELVXTQSPDSLAVSLGERATINCKSSQSVLYSSNNKSYLAWYQQKPGQPPKLLIYWASTRESGVPDRFSGSGSGTDFTLTISSLQAEDVAVYYCQQYYSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNR

SEQ ID NO: 4019 - protein, 217 aa, Artificial Sequence
  Description of Artificial Sequence: Synthetic polypeptide
DIVLTQSPASLAVSLGQRATISCRASKSVSTSGYSYMHWNQQKPGQPPRLLIYLVSNLESGVPARFSGSGSGTDFTLNIAPVEEEDAATYYCQHIAELTRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNE

SEQ ID NO: 4020 - protein, 48 aa, Artificial Sequence
  Description of Artificial Sequence: Synthetic polypeptide
DIQMTQSPSSLSASVGDRVTITCKRQASQDVTTAVAWYQQKPGKAPKL

SEQ ID NO: 4021 - protein, 44 aa, Artificial Sequence
  Description of Artificial Sequence: Synthetic polypeptide
LIYAASGRHKGVPSRFSGSGSGTDFTLTISSLQPEDFATYYCQQ

SEQ ID NO: 4022 - protein, 44 aa, Artificial Sequence
  Description of Artificial Sequence: Synthetic polypeptide
LIYAASRLHNGVPSRFSGSGSGTDFTLTISSLQPEDFATYYCQQ

SEQ ID NO: 4023 - protein, 44 aa, Artificial Sequence
  Description of Artificial Sequence: Synthetic polypeptide
LIYAASTRHTGVPSRFSGSGSGTDFTLTISSLQPEDFATYYCQQ

SEQ ID NO: 4024 - protein, 16 aa, Artificial Sequence
  Description of Artificial Sequence: Synthetic peptide
HYSTPLTFGQGTKVFI

SEQ ID NO: 4025 - protein, 127 aa, Artificial Sequence
  Description of Artificial Sequence: Synthetic polypeptide
MVSSAQFLGLLLLCFQGTRCDIQMTQTTSSLSASLGDRVTISCRASQDINNYLNWYQQKPDGTVKLLIYYTSRLHSGVPSRFSGSGSGTDYSLTISNLQQEDIAAYFCQQGNTLPLTFGAGTKLELK

SEQ ID NO: 4026 - protein, 137 aa, Artificial Sequence
  Description of Artificial Sequence: Synthetic polypeptide
MAWVWTLLFLMAAAQSFQAQIQLVQSGPELKKPGETVKISCKASGYTFTVYSMHWVKQAPGKGLKWMGWINPETGEPTYADDFKGRFAFSLEISASTASLQINNLKNEDTATYFCARGGDNYAVDYWGQGTSVTVSS

SEQ ID NO: 4027 - protein, 104 aa, Artificial Sequence
  Description of Artificial Sequence: Synthetic polypeptide
MTQSPKFLLVSAGDRVTLTCKASQSVNNDVYWYQQEPGQSPKLLIYWASTRESGVPDRFTGSGSGTDFTLTISSVQAEDLAVYYCKQSYNLYTFGGGTKLEIKR

SEQ ID NO: 4028 - protein, 106 aa, Artificial Sequence
  Description of Artificial Sequence: Synthetic polypeptide
QSPSSLAVSAGEKVTMSCKSSQSLLNSRTRKNYLAWYQQKPGQSPKLLIYWASTRESGVPDRFTGSGSGTDFTLTISSVQAEDLAVYYCKQSNLYTFGGGTKLEIK

SEQ ID NO: 4029 - protein, 107 aa, Artificial Sequence
  Description of Artificial Sequence: Synthetic polypeptide
QSPSSLAVSAGEKVTMSCKSSQSLLNSRTRKNYLAWYQQKPGQSPKLLIYWASTRESGVPDRFTGSGSGTDFTLTISSVQAEDLAVYYCKQSYNLYTFGGGTKLEIK

SEQ ID NO: 4030 - protein, 117 aa, Artificial Sequence
  Description of Artificial Sequence: Synthetic polypeptide
QVQLMESGPELKKPGETVKISCTTSGYTPTYAMHWVKQAPGKGLEWMGWINTATGEPTYAYDFKERFGFSLETSASTAFLQISNLKIEDTATYFCASDGRYWYFGVWGAGTTVTVSS

SEQ ID NO: 4031 - protein, 130 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADRSISTAYLQWSSLKASDTAMYYCARLRGPYYDFWNGYRETHDAFNVWGQGTTVTVSS

SEQ ID NO: 4032 - protein, 130 aa, Artificial Sequence
  Description of Artificial Sequence: Synthetic polypeptide
EVQLVQSGAEVKKSGESLKISCKGSGYTFNTYWIGWVRQMPGKGLEWMGIIYPGDSDTIYSPSFQGQVTISADKSISTAYLQWSSLKASDSAMYYCARLTFRRGYSGSDSFLPPGDFDYWGQGTLVTVSS

SEQ ID NO: 4033 - protein, 125 aa, Artificial Sequence
  Description of Artificial Sequence: Synthetic polypeptide
QMQLVQSGAEVKKPGESLRISCKGSGYSFTSNWITWVRQMPGKGLEWMGRIDPSDSYTNYSPSFQGHVTISADKSISTAYLQWSSLKASDTAMYYCARDVVGVGASDYYYYMDVWGKGTTVTVSS

SEQ ID NO: 4034 - protein, 119 aa, Artificial Sequence
  Description of Artificial Sequence: Synthetic polypeptide
EVQLVQSGGGVVQPGRSLRLSCVASGFTFSKDAMHWVRQAPGKGLEWVAVISYDGSDKHYADSVKGRVTISRDNSRKTLYLRMDSLRAEDTALYYCARGYNSGHYFDYWGQGTLITVSS

SEQ ID NO: 4035 - protein, 117 aa, Artificial Sequence
  Description of Artificial Sequence: Synthetic polypeptide
QMQLVQSGAEVKKPGSSVKVSCKASGDTFSSYAISWVRQAPGQGLEWMGGIFGTASYAQKFQGRVTITADESTSTAYMELSSLRSEDTAVYYCARGGMATTPGLDYWGQGTLVTVSS

SEQ ID NO: 4036 - protein, 127 aa, Artificial Sequence
  Description of Artificial Sequence: Synthetic polypeptide
EVQLVQSGGGVVQPGRSLRLSCAASGFTFSNYAMHWVRQAPGKGLEWVAVISYDGGNKYYADSVKGRFTMSRDNSKNTLYLQMNSLRAEDTAVYYCARDFWSGYSMVDSYYYYMDVWGKGTTVTVSS

SEQ ID NO: 4037 - protein, 130 aa, Artificial Sequence
  Description of Artificial Sequence: Synthetic polypeptide
EVQLVQSGAEVKKPGESLKISCKASGFSFSTYWIGWVRQMPGKGLEWMGIIYPADSDTRYSPSFQGQVTISADKSISTAYLQWSSLKASDTAMYYCARLRGPYYDFWNGYRETHDAFNVWGQGTMVTVSS

SEQ ID NO: 4038 - protein, 130 aa, Artificial Sequence
  Description of Artificial Sequence: Synthetic polypeptide
QVTLKESGPALVKPTQTLTLTCTFSGFSLSTSGVGVGWIRQPPGKALEWLAVIYWNDDKLYRPSLKSRLTITKDTSKNQVVLTMTKMDPVDTATYYCAHRHRYYDISGYYRLFSDAFDIWGQGTMVTVSS

SEQ ID NO: 4039 - protein, 130 aa, Artificial Sequence
  Description of Artificial Sequence: Synthetic polypeptide
QVTLKESGPTLVKPTQTLTLTCTFSGFSLSTSGVGVGWIRQPPGKALEWLAVIYWNDDKLYRPSLKSRLTITKDTSKNQVVLTMTKMDPVDTATYYCAHRHRYYDISGYYRLFSDAFDIWGQGTMVTVSS

SEQ ID NO: 4040 - protein, 130 aa, Artificial Sequence; identical to SEQ ID NO: 4039
  Description of Artificial Sequence: Synthetic polypeptide

SEQ ID NO: 4041 - protein, 456 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGNIGYADSVKGRFTISRDNAKNSLYLQMNSLRAEDTALYYCAKDKSYYYGSGTSGGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4042 - protein, 453 aa, Artificial Sequence
  Description of Artificial Sequence: Synthetic polypeptide
QVQLVQSGAEVRKPGASVKVSCKASGYTFTHYYMHWVRQAPGQGLEWMGIINPSGGSTTYAQKLQGRVTMTRDTSTSTVYMELSSLRSEDTAVYYCARDWGSNYVWGSYPKYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4043 - protein, 448 aa, Artificial Sequence
  Description of Artificial Sequence: Synthetic polypeptide
QVQLVQSGVEVKRPGASVKVSCKASGYTFTSYTLHWVRQAPGQRPEWMGWIHPVNGDTKYSQKFQGRVTITRDTSASTAYMELSSLRSEDTAVYYCARGYDSWSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4044 - protein, 459 aa, Artificial Sequence
  Description of Artificial Sequence: Synthetic polypeptide
QVQLVQSGTEVKKPGSSVKVSCKASGGTFSNYAISWVRQAPGQGLEWMGGIVPKFATTSYAQRFQGRVTITADESTSTVYMELSSLRSEDTAVYFCARFGVVVAADRQGAYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4045 - protein, 448 aa, Artificial Sequence
  Description of Artificial Sequence: Synthetic polypeptide
QVQLVQSGAEMKKPGASVKVSCKASGYTFTSYAMHWVRQAPGQRLEWMGWINAGNGNTKYSQKFQGRVTITRDTSASTAYMELSSLRSEDTAVYYCARGYDSWSFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4046 - protein, 449 aa, Artificial Sequence
  Description of Artificial Sequence: Synthetic polypeptide
QVQLVESGGGVVQPGRSLRLSCVASGFTFSKDAMHWVRQAPGKGLEWVAVISYDGSDKHYADSVKGRVTISRDNSRKTLHLRMDSLRAEDTALYYCARGYNSGHYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4047 - protein, 456 aa, Artificial Sequence
  Description of Artificial Sequence: Synthetic polypeptide
QVQLVQSGAEVKKPGASVKVSCKTSGYTFTDYYLHWVRHAPGQGLEWMGWINPNSGDTNYAQKFQGRVTMTRDTSISTAYMDLSRLRSDDAAVYYCARDWNTVTTYYYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4048 - protein, 576 aa, Artificial Sequence
  Description of Artificial Sequence: Synthetic polypeptide
QVQLVQSGAEVRKPGASVKVSCKASGYTFTHYYMHWVRQAPGQGLEWMGIINPSGGSTTYAQKLQGRVTMTRDTSTSTVYMELSSLRSEDTAVYYCARDWGSNYVWGSYPKYWGQGTLVTVSSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPGEVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 4049 - protein, 121 aa, Artificial Sequence
  Description of Artificial Sequence: Synthetic polypeptide
QVQLVQSGAEVRKPGASVKVSCKASGYTFTHYYMHWVRQAPGQGLEWMGIINPSGGSTTYAQKLQGRVTMTRDTSTSTVYMELSSLRSEDTAVYYCARDWGSNYVWGSYPKYWGQGTLVTV

SEQ ID NO: 4050 - protein, 119 aa, Artificial Sequence
  Description of Artificial Sequence: Synthetic polypeptide
QVQLVQSGAEVKKPGASVKVSCKASGYTFTDYWIEWVRQAPGQGLEWMGDILCGTGRTRYNEKLKARVTMTTDTSTSTAYMELRSLRSDDTAVYYCARSASYGDYADYWGQGTTVTVSS

SEQ ID NO: 4051 - protein, 119 aa, Artificial Sequence
  Description of Artificial Sequence: Synthetic polypeptide
QVQLVQSGAEVKKPGASVKVSCKASGYTFTDYWIEWVRQAPGQGLEWMGDILCGTGRTRYNEKLKARATFTADTSTSTAYMELRSLRSDDTAVYYCARSASYGDYADYWGQGTTVTVSS

SEQ ID NO: 4052 - protein, 119 aa, Artificial Sequence
  Description of Artificial Sequence: Synthetic polypeptide
QVQLVQSGAEVKKPGASVKVSCKASGYTFTDYWIEWVRQAPGQGLEWMGDILCGTGRTRYNEKLKARVTMTADTSTSTAYMELRSLRSDDTAVYYCARSASYGDYADYWGQGTTVTVSS

SEQ ID NO: 4053 - protein, 124 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGNIGYADSVKGRFTISRDNAKNSLYLQMNSLRAEDTALYYCAKDKSYYYGSGTSGGWFDPWGQGTLVTV

SEQ ID NO: 4054 - protein, 449 aa, Artificial Sequence
  Description of Artificial Sequence: Synthetic polypeptide
QVQLVQSGAEVKKPGASVKVSCKASGYTFTDYWIEWVRQAPGQGLEWMGDILCGTGRTRYNEKLKARVTMTADTSTSTAYMELRSLRSDDTAVYYCARSASYGDYADYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4055 - protein, 449 aa, Artificial Sequence; identical to SEQ ID NO: 4054
  Description of Artificial Sequence: Synthetic polypeptide

SEQ ID NO: 4056 - protein, 119 aa, Artificial Sequence
  Description of Artificial Sequence: Synthetic polypeptide
QVQLQQSGSELMKPGASVQISCKATGYTFSDYWIEWVKQRPGHGLEWIGDILCGTGRTRYNEKLKAMATFTADTSSNTAFMQLSSLTSEDSAVYYCARSASYGDYADYWGHGTTLTVSS

SEQ ID NO: 4057 - protein, 119 aa, Artificial Sequence
  Description of Artificial Sequence: Synthetic polypeptide
QVQLQQSGPELVKPGALVKISCKASGHTFTSYDINWVKQRPGQGLEWIGWIYPGDGRIKYNEKFKGKAILTADKSSSTAYMQLSSLTSENSAVYFCARGGSSGTYFDYWGQGTTLTVSS

SEQ ID NO: 4058 - protein, 119 aa, Artificial Sequence
  Description of Artificial Sequence: Synthetic polypeptide
QVQLQQSGPELVKPGTLVKISCKTSGYTFTSYDINWVKQRPGQGLEWIGWIFPGDGRIKYNEQIKDKATLTADKSSSTAYMELSSLTSENSAVYFCARASYYGSIFDYWGQGTTLTVSS

SEQ ID NO: 4059 - protein, 118 aa, Artificial Sequence
  Description of Artificial Sequence: Synthetic polypeptide
QVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSS

SEQ ID NO: 4060 - protein, 118 aa, Artificial Sequence; identical to SEQ ID NO: 4059
  Description of Artificial Sequence: Synthetic polypeptide

SEQ ID NO: 4061 - protein, 118 aa, Artificial Sequence; identical to SEQ ID NO: 4059
  Description of Artificial Sequence: Synthetic polypeptide

SEQ ID NO: 4062 - protein, 118 aa, Artificial Sequence; identical to SEQ ID NO: 4059
  Description of Artificial Sequence: Synthetic polypeptide

SEQ ID NO: 4063 - protein, 118 aa, Artificial Sequence; identical to SEQ ID NO: 4059
  Description of Artificial Sequence: Synthetic polypeptide

SEQ ID NO: 4064 - protein, 118 aa, Artificial Sequence; identical to SEQ ID NO: 4059
  Description of Artificial Sequence: Synthetic polypeptide

SEQ ID NO: 4065 - protein, 118 aa, Artificial Sequence; identical to SEQ ID NO: 4059
  Description of Artificial Sequence: Synthetic polypeptide

SEQ ID NO: 4066 - protein, 118 aa, Artificial Sequence
  Description of Artificial Sequence: Synthetic polypeptide
QVQLVQSGAEVKKPGSSVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSS

SEQ ID NO: 4067 - protein, 127 aa, Artificial Sequence
  Description of Artificial Sequence: Synthetic polypeptide
QVQLVQSGAEVKEPGSSVKVSCKASGGTFSNYPISWVRQAPGQGLEWMGGIIPITNSPGYAQKFQGRVTISADESTGTVYMELSSLRSEDTAIYYCAKDPNRYESGVLHYWHGLDVWGQGTTVTVSS

SEQ ID NO: 4068 - protein, 120 aa, Artificial Sequence
  Description of Artificial Sequence: Synthetic polypeptide
QVQLVQSGAEVKKPGSSVKVSCKASGGTFSSYAISWVRQAPGQGLEWMGWMNSNTGDTGYAQKFQGRVTMTRNTSTSTAYMELSSLRSEDTAVYYCAKISNYHYYAMDVWGQGTLVTVSS

SEQ ID NO: 4069 - protein, 120 aa, Artificial Sequence
  Description of Artificial Sequence: Synthetic polypeptide
EVQLVQSGAEVKKPGASVKVSCKASGYTFTSYGISWVRQAPGQGLEWLGWINPNSGDTVYSQKFQGRVTMTSDKSVSTAYMELSSLRSDDTAVYYCASPGKNYYYGMDVWGQGTLVTVSS

SEQ ID NO: 4070 - protein, 122 aa, Artificial Sequence
  Description of Artificial Sequence: Synthetic polypeptide
EVQLVETGAEVKKPGESLRISCKGSGYTFNNYWIGWVRQMPGKGLEWMGIIYPGDSDTRYSPSVQGHVTISADKSINTAYLQWSSLKASDTAVYYCARRPGYDYGFYYFDYWGQGTLVTVSS

SEQ ID NO: 4071 - protein, 468 aa, Artificial Sequence
  Description of Artificial Sequence: Synthetic polypeptide
MGWSCIILFLVATATGVHSQVQLVQSGAEVKKPGASVKVSCKASGYTFTDYWIEWVRQAPGQGLEWMGDILCGTGRTRYNEKLKARVTMTADTSTSTAYMELRSLRSDDTAVYYCARSASYGDYADYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4072 - protein, 140 aa, Artificial Sequence
  Description of Artificial Sequence: Synthetic polypeptide
MNFGLSLIFLVLVLKGVQCEVKLVESGGGLVKPGGSLKLSCAASGFTFTNYAMSWVRQTPEKRLEWVASISSGHTPYYPDSVKGRFTISRDNARNILFLQMSSLRSEDTAMYYCARGDYYGSVYSAMDYWGQGTSVTVSS

SEQ ID NO: 4073 - protein, 115 aa, Artificial Sequence
  Description of Artificial Sequence: Synthetic polypeptide
ESGRGLVQPGGSRKLSCAASGFTFSTSGMHWVRQAPEKGLEWVAYISSGSTTIYHADTVKGRFTISRDNPKNTLFLQMTSLRSEDTAMYYCCARSGQFGNYFDYWGQGTTLTVSS

SEQ ID NO: 4074 - protein, 116 aa, Artificial Sequence
  Description of Artificial Sequence: Synthetic polypeptide
QVQLEESGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGTTLTV

SEQ ID NO: 4075 - protein, 117 aa, Artificial Sequence
  Description of Artificial Sequence: Synthetic polypeptide
QVQLEQSGPELVKPGASVKLSCKASGYTFTEYIIHWVKQRSGQGLEWIGWFYPGSGSIKYNEKFKDKATLTADKSSSTVYMELSGLTSEDSAVYFCARHDGYSYFDYWGQGGTTLTV

SEQ ID NO: 4076 - protein, 107 aa, Artificial Sequence
  Description of Artificial Sequence: Synthetic polypeptide
DIVLTQSPASLAVSLGQRATISYRASQSVSTSGYSYMHWNQQKPGQPPRLLIYLVSNLESGVPARFSGSGSGTDFYLNIHPVEEEDAATYYCQHIRELTRSEAGPSW

SEQ ID NO: 4077 - protein, 215 aa, Artificial Sequence
  Description of Artificial Sequence: Synthetic polypeptide
STDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4078 - protein, 216 aa, Artificial Sequence
  Description of Artificial Sequence: Synthetic polypeptide
QSVLTQPPSVSAAPGQKVTISCSGSSSNIGSNTVNWYQQLPGTAPKLLIYSNNQRPSGIPDRFSGSKSGTSASLAISGLQSEDEADYYCAAWDDSLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4079 - protein, 223 aa, Artificial Sequence
  Description of Artificial Sequence: Synthetic polypeptide
STQAVLTQPSSASGTPGQRVTISCSGSSPNIGSNNVNWYQQLPGTAPKLLIYSNNQRPSGVPGRFSGSKSGTSASLAISGLQSEDEADYYCAAWDDGLSGNYVFGAGTQLTVLSAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4080 - protein, 216 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDTLNGYVFGTGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4081 - protein, 222 aa, Artificial Sequence
  Description of Artificial Sequence: Synthetic polypeptide
STQAVLTQPSSVSGTPGQRVTISCSGSSSNIGSNTVNWYQQLPGTAPKLLIYGNNNRPSGVPARFSGSRSGTSASLAISGLRSEDEADYYCAAWDDSLNGPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4082 - protein, 222 aa, Artificial Sequence
  Description of Artificial Sequence: Synthetic polypeptide
STQSVLTQPPSTSGTPGQRVTISCSGSDSNIGSNTVNWYQQLPGMAPKLLIYRNNQRPSGVPDRFSGSKSGTSASLAISGLQSEDEADYFCASWDANLGGPLFGGGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4083 - protein, 222 aa, Artificial Sequence
  Description of Artificial Sequence: Synthetic polypeptide
STQSVLTQPPSASGTPGQRVTISCSGGISNIGSNSVNWFQQLPGTAPKLLLYSNNQRASGVPDRFSGSKSGTSASLAISGLQSEDEVDYYCAAWDDRLIGYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4084 - protein, 110 aa, Artificial Sequence
  Description of Artificial Sequence: Synthetic polypeptide
STDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIKR

SEQ ID NO: 4085 - protein, 111 aa, Artificial Sequence
  Description of Artificial Sequence: Synthetic polypeptide
QSVLTQPPSVSAAPGQKVTISCSGSSSNIGSNTVNWYQQLPGTAPKLLIYSNNQRPSGIPDRFSGSKSGTSASLAISGLQSEDEADYYCAAWDDSLNGPVFGGGTKLTVLG

SEQ ID NO: 4086 - protein, 107 aa, Artificial Sequence
  Description of Artificial Sequence: Synthetic polypeptide
DIVMTQSHKFMSTSVGDRVSITCKASQDVSTAVAWYQQKPGQSPKLLISWASTRHTGVPDRFTGSGSGTDYTLTISSVQAEDLALYYCQQHYTTPLTFGAGTKLELK

SEQ ID NO: 4087 - protein, 107 aa, Artificial Sequence
  Description of Artificial Sequence: Synthetic polypeptide
DIVMTQSHKFMSTSVGDRVSITCKASQDVSTAVAWYQQKPGQSPKVLIYWASTRHTGVPDRFTGSGSGTDYTLTISSVQAEDLALYYCQQHYSNPPTFGGGTKLEIK

SEQ ID NO: 4088 - protein, 107 aa, Artificial Sequence
  Description of Artificial Sequence: Synthetic polypeptide
DIVMTQSHKFMSTSVGDRVNITCKASQDVSTAVAWYQQKPGQSPKLLIYWASTRHTGVPDRFTGSGSGTHYTLTISSVQAEDLALYYCQQHYTTPLTFGAGTKLELK

SEQ ID NO: 4089 - protein, 107 aa, Artificial Sequence
  Description of Artificial Sequence: Synthetic polypeptide
DIVMTQSPDSLAVSLGERATINCKASQDVSTAVAWYQQKPGQPPKLLIYWASTRHTGVPDRFSGSGSGTDFTLTISSLQAEDVAVYYCQQHYTTPLTFGQGTKLEIK

SEQ ID NO: 4090 - protein, 107 aa, Artificial Sequence
  Description of Artificial Sequence: Synthetic polypeptide
DIVMTQSPDSLAVSLGERATINCKASQDVSTAVAWYQQKPGQPPKLLISWASTRHTGVPDRFSGSGSGTDFTLTISSLQAEDVAVYYCQQHYTTPLTFGQGTKLEIK

SEQ ID NO: 4091 - protein, 105 aa, Artificial Sequence
  Description of Artificial Sequence: Synthetic polypeptide
SSELTQDPAVSVALGQTVRITCRGDSLRSYYASWYQQKPGQAPVLVIYGENNRPSGIPDRFSGSSSGDTASLTITGAQAEDEADYYCNSRDSSDHLLLFGGGTKL

SEQ ID NO: 4092 - protein, 111 aa, Artificial Sequence
  Description of Artificial Sequence: Synthetic polypeptide
SYELTQPPSASGTTGQRVTISCSGSSSNIGSNTVNWYQQLPGTAPKLLIYSNNQRPSGVPDRLSGSKSGTSASLAISGLQSEDEADYYCAAWDARLTGPLFGGGTKLSVLR

SEQ ID NO: 4093 - protein, 111 aa, Artificial Sequence
  Description of Artificial Sequence: Synthetic polypeptide
SYELTQPPSASGTPGQRVTISCSGSSSNIGSNTVNWYQQLPGTAPKLLIYSNNQRPSGVPDRFSGSKSGTSASLAISGLQSEDEADYYCAAWDARLTGPLFGGGTKLSVLR

SEQ ID NO: 4094 - protein, 109 aa, Artificial Sequence
  Description of Artificial Sequence: Synthetic polypeptide
SSELTQDPAVSVALGQTVTITCQGGGLRNYYASWYQQKPGQAPVLLVYGRDNRPSGIPDRFSGSSSGNTASLTITGAQAEDEADYYCNSRDSSGNHLVFGGGTKLTVLG

SEQ ID NO: 4095 - protein, 110 aa, Artificial Sequence
  Description of Artificial Sequence: Synthetic polypeptide
QSALTQPASVSGSPGQSITISCTGTNSDVGIYNLVSWYQQHPGKAPKLMIYDVSNRPSGVSSRFSGSNSGNTATLTISGLQAEDEADYYCSAHAGDNTQFGGGTKLTVLS

SEQ ID NO: 4096 - protein, 111 aa, Artificial Sequence
  Description of Artificial Sequence: Synthetic polypeptide
  MOD_RES (61)..(61): Any amino acid
  MOD_RES (65)..(65): Any amino acid
QSALTQPASVSGSPGQSITISCTGTSSDLGGHNFVSWYQQHPGKAPKLMIYDVFNRPSGVXSRFXGSKSGNTASLTISGLQAEDEADYFCSSYTITSIVVFGGGTKLTVLG

SEQ ID NO: 4097 - protein, 110 aa, Artificial Sequence
  Description of Artificial Sequence: Synthetic polypeptide
QSVLTQPPSVSVAPGKTARIPCGGNNSGTKSVHWYQQKPGQAPVLVIYDDRVRPSGIPERFSGSNSGDTATLTISRVAAGDEADYYCQVSDGSGDPPTWVFGGGTRLTVL

SEQ ID NO: 4098 - protein, 111 aa, Artificial Sequence
  Description of Artificial Sequence: Synthetic polypeptide
QTVVTQEPSFSVSPGGTITLTCGLSSGSVFTSYYPSWYQQTPGQAPRTLIYSTNTRSSGVPDRFSGSILGNKAALTITGAQADDESDYYCVLYMGSGIGVFGTGTKVTVLG

SEQ ID NO: 4099 - protein, 110 aa, Artificial Sequence
  Description of Artificial Sequence: Synthetic polypeptide
LPVLTQPPSASGTPGQTVTLSCSGSSSNIGSNTVNWYQQLPGTAPKLLIYSNNQRPSGVPDRFSASKSGTSASLAITGLQAEDEADYFCAAWDDSLVYVFGTGTKVTVLG

SEQ ID NO: 4100 - protein, 111 aa, Artificial Sequence
  Description of Artificial Sequence: Synthetic polypeptide
LPVLTQPPSASGTSGQTVTISCSGGSSNIGSHLVTWYQQFPGTAPKVLIHTNDQRPSGVPDRISGSKSGTSASLAISGLQSDDEGDYYCAAWDDSLNGYVFGTGTKVTVLG

SEQ ID NO: 4101 - protein, 111 aa, Artificial Sequence
  Description of Artificial Sequence: Synthetic polypeptide
QPVLTQPPSASGTPGQRVTISCSGSSSNIGSNLIYWYQQLPGTAPKLLIYSNNQRPSGVPDRFSGSKSGTSASLAISGLRSEDEADYFCSAWDDSLGGEVFGTGTKVNVLG

SEQ ID NO: 4102 - protein, 111 aa, Artificial Sequence
  Description of Artificial Sequence: Synthetic polypeptide
QSALTQPRSVSGSPGQSVTISCTGTSSDVGGYNYVSWYQHHPGKAPKLMIYDVSNRPLGVSNRFSGSKSGNTASLTISGLQAEDEADYYCSSYTSSSTYVFGTGTHLTVLS

SEQ ID NO: 4103 - protein, 114 aa, Artificial Sequence
  Description of Artificial Sequence: Synthetic polypeptide
DIQMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPPTFGGGTKVEIKR

SEQ ID NO: 4104 - protein, 108 aa, Artificial Sequence
  Description of Artificial Sequence: Synthetic polypeptide
DIQMTQSPSTLSASVGDRVTITCRASQSISSWLAWYQQKPGKAPNLLIYAASSLQSGVPSRFSGSGSGTDFTLTISSLQPDDSATYYCQQYNTYPLTFGGGTKVEIKR

SEQ ID NO: 4105 - protein, 110 aa, Artificial Sequence
  Description of Artificial Sequence: Synthetic polypeptide
EIVLTQSPGTLSLSPGETATLSCRTSQSVSSSYLGWYQQKPGQAPRLLIYGASIRATGIPARFSGSGSGTEFTLTIDSLQSEDFAVYYCQQYNNWPPITFGQGTRLEIKR

SEQ ID NO: 4106 - protein, 111 aa, Artificial Sequence
  Description of Artificial Sequence: Synthetic polypeptide
SYVLTQPPSLSAAPRQRVTISCSGSSSNIGNYGVNWYQQLPGKAPKLLIYYDDLLPSGVSDRFSGSKSGTSASLAISGLQSEDEGDYYCAAWDDTLSAWVFGGGTKLTVLG

SEQ ID NO: 4107 - protein, 124 aa, Artificial Sequence
  Description of Artificial Sequence: Synthetic polypeptide
EVQLVETGGGVVQPGRSLRLSCAASGFTFSGYAMHWVRQAPGKGLDWVAVISYDGSEKYSADSVKGRFTISRDNSKNTLYLQMNSLRAEDTAVYYCAKESGGPIWYKYYGVDVWGQGTTVTVSS

SEQ ID NO: 4108 - protein, 111 aa, Artificial Sequence
  Description of Artificial Sequence: Synthetic polypeptide
QSVLTQPPSVSAAPGQKVTISCSGTSSNIGDNYVSWYQHLPGTAPKLLIYDNNKRPSGIPDRFSGSKSGTSATLGVTGLQTGDEADYYCGTWDSSLTAVVFGGGTKLTVLG

SEQ ID NO: 4109 - protein, 114 aa, Artificial Sequence
  Description of Artificial Sequence: Synthetic polypeptide
DIQLTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGQGTKVEIKR

SEQ ID NO: 4110 - protein, 108 aa, Artificial Sequence
  Description of Artificial Sequence: Synthetic polypeptide
ETTLTQSPGTLSLSPGERATLSCRASQSVSNTFLAWYQQKPGQAPRLLIYGASSRATGIPDRFSGSGSGTDFTLTISRLEPEDFAAYYCQQYGSSLTFGPGTKVDIKR

SEQ ID NO: 4111 - protein, 114 aa, Artificial Sequence
  Description of Artificial Sequence: Synthetic polypeptide
DVVMTQSPDSLAVSLGERATINCKSSQNILDNSDNKNFLAWYQQKPGQPPKLLIYWASARESGVPDRFSGSGSGTDFTLTISSLQAEDVALYYCQQYYNTPITFGQGTRLEIKR

SEQ ID NO: 4112 - protein, 115 aa, Artificial Sequence
  Description of Artificial Sequence: Synthetic polypeptide
QAVLTQPSSVSGAPGQRVTISCTGSSSNIGAGYDVHWYQQLPGTAPKLLIYGNSNRPSGVPDRFSGSKSGTSASLAITGLQAEDEADYYCQSYDSSLSGSDNYVFGTGTKVTVLG

SEQ ID NO: 4113 - protein, 112 aa, Artificial Sequence
  Description of Artificial Sequence: Synthetic polypeptide
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSVFGGGTKLTVLG

SEQ ID NO: 4114 - protein, 112 aa, Artificial Sequence
  Description of Artificial Sequence: Synthetic polypeptide
QSVVTQPPSVSGAPGQRVTISCTGSSSNIGAGYDVHWYQQLPGTAPKLVIYGSNNRPSGVPGRFSGSKSGTSASLAITGLQAEDEADYYCQSYDSSLSAAVFGGGTKVTVLG

SEQ ID NO: 4115 - protein, 233 aa, Artificial Sequence
  Description of Artificial Sequence: Synthetic polypeptide
MGWSCIILFLVATATGVHSDIVMTQSPDSLAVSLGERATINCKASQDVSTAVAWYQQKPGQPPKLLISWASTRHTGVPDRFSGSGSGTDFTLTISSLQAEDVAVYYCQQHYTTPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4116 - protein, 127 aa, Artificial Sequence
  Description of Artificial Sequence: Synthetic polypeptide
MRAPAHFFGFLLLWFPGINCDIRMTQSPSSMYASLGERVTVTCKASQDINSYLSWLQQKPGKSPKTLIYRANRLFDGVPSRFSGSGSGQDYSLTISSLEYEDMGIFYCLQYDEFPFTFGSGTKLEIK

SEQ ID NO: 4117 - protein, 328 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKAEPKSCDKTHTCPPCPAPELLGGPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4118 - protein, 328 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPEAAGGPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4119 - protein, 264 aa, Artificial Sequence
  Description of Artificial Sequence: Synthetic polypeptide
MAQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSGGGGSGGGGSGGGGSSSELTQDPAVSVALGQTVRITCRGDSLRSYYASWYQQKPGQAPVLVIYGENNRPSGIPDRFSGSSSGDTASLTITGAQAEDEADYYCNSRDSSDHLLLFGGGTKLTVLGQPKATPSAAAEQKLISEEDL

SEQ ID NO: 4120 - protein, 266 aa, Artificial Sequence
  Description of Artificial Sequence: Synthetic polypeptide
MAQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSGGGGSGGGGSGGGGSSYELTQPPSASGTTGQRVTISCSGSSSNIGSNTVNWYQQLPGTAPKLLIYSNNQRPSGVPDRLSGSKSGTSASLAISGLQSEDEADYYCAAWDARLTGPLFGGGTKLSVLRQPKAAPSAAAEQKLISEEDL

SEQ ID NO: 4121 - protein, 266 aa, Artificial Sequence
  Description of Artificial Sequence: Synthetic polypeptide
MAQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSGGGGSGGGGSGGGGSSYELTQPPSASGTPGQRVTISCSGSSSNIGSNTVNWYQQLPGTAPKLLIYSNNQRPSGVPDRFSGSKSGTSASLAISGLQSEDEADYYCAAWDARLTGPLFGGGTKLSVLRQPKAAPSAAAEQKLISEEDL

SEQ ID NO: 4122 - protein, 264 aa, Artificial Sequence
  Description of Artificial Sequence: Synthetic polypeptide
MAQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSGGGGSGGGGSGGGGSSSELTQDPAVSVALGQTVTITCQGGGLRNYYASWYQQKPGQAPVLLVYGRDNRPSGIPDRFSGSSSGNTASLTITGAQAEDEADYYCNSRDSSGNHLVFGGGTKLTVLGQPKATPSAAAEQKLISEEDL

SEQ ID NO: 4123 - protein, 265 aa, Artificial Sequence
  Description of Artificial Sequence: Synthetic polypeptide
MAQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSGGGGSGGGGSGGGGSQSALTQPASVSGSPGQSITISCTGTNSDVGIYNLVSWYQQHPGKAPKLMIYDVSNRPSGVSSRFSGSNSGNTATLTISGLQAEDEADYYCSAHAGDNTQFGGGTKLTVLSQPKAAPSAAAEQKLISEEDL

SEQ ID NO: 4124 - protein, 307 aa, Artificial Sequence
  Description of Artificial Sequence: Synthetic polypeptide
  MOD_RES (237)..(237): Any amino acid
  MOD_RES (241)..(241): Any amino acid
EQLDHDYAKLACKFYFKETVIMKYLLPTAAAGLLLLAAQPAMAQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSGGGGSGGGGSGGGGSQSALTQPASVSGSPGQSITISCTGTSSDLGGHNFVSWYQQHPGKAPKLMIYDVFNRPSGVXSRFXGSKSGNTASLTISGLQAEDEADYFCSSYTITSIVVFGGGTKLTVLGQPKATPSAAAEQKLISEEDL

SEQ ID NO: 4125 - protein, 266 aa, Artificial Sequence
  Description of Artificial Sequence: Synthetic polypeptide
MAQVQLVQSGAEVKKPGASVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSGGGGSGGGGSGGGGSQSVLTQPPSVSVAPGKTARIPCGGNNSGTKSVHWYQQKPGQAPVLVIYDDRVRPSGIPERFSGSNSGDTATLTISRVAAGDEADYYCQVSDGSGDPPTWVFGGGTRLTVLGQPKAAPSAAAEQKLISEEDL

SEQ ID NO: 4126 - protein, 266 aa, Artificial Sequence
  Description of Artificial Sequence: Synthetic polypeptide
MAQVQLVQSGAEVKKPGSSVKVSCKASGYTFSGYSTHWLRQVPGQGLEWIGWDNPSSGDTTYAENFRGRVTLTRDTSITTDYLEVRGLRSDDTAVYYCARGGDDYSFDHWGQGTLVTVSSSGGGSGGGGSGGGGSQTVVTQEPSFSVSPGGTITLTCGLSSGSVFTSYYPSWYQQTPGQAPRTLIYSTNTRSSGVPDRFSGSILGNKAALTITGAQADDESDYYCVLYMGSGIGVFGTGTKVTVLGQPKAAPSAAAEQKLISEEDL

SEQ ID NO: 4127 - protein, 274 aa, Artificial Sequence
  Description of Artificial Sequence: Synthetic polypeptide
MAQVQLVQSGAEVKEPGSSVKVSCKASGGTFSNYPISWVRQAPGQGLEWMGGIIPITNSPGYAQKFQGRVTISADESTGTVYMELSSLRSEDTAIYYCAKDPNRYESGVLHYWHGLDVWGQGTTVTVSSGGGGSGGGGSGGGGSLPVLTQPPSASGTPGQTVTLSCSGSSSNIGSNTVNWYQQLPGTAPKLLIYSNNQRPSGVPDRFSASKSGTSASLAITGLQAEDEADYFCAAWDDSLVYVFGTGTKVTVLGQPKAAPSAAAEQKLISEEDL

SEQ ID NO: 4128 - protein, 268 aa, Artificial Sequence
  Description of Artificial Sequence: Synthetic polypeptide
MAQVQLVQSGAEVKKPGSSVKVSCKASGGTFSSYAISWVRQAPGQGLEWMGWMNSNTGDTGYAQKFQGRVTMTRNTSTSTAYMELSSLRSEDTAVYYCAKISNYHYYAMDVWGQGTLVTVSSGGGGSGGGGSGGGGSLPVLTQPPSASGTSGQTVTISCSGGSSNIGSHLVTWYQQFPGTAPKVLIHTNDQRPSGVPDRISGSKSGTSASLAISGLQSDDEGDYYCAAWDDSLNGYVFGTGTKVTVLGQPKATPSAAAEQKLISEEDL

SEQ ID NO: 4129 - protein, 268 aa, Artificial Sequence
  Description of Artificial Sequence: Synthetic polypeptide
MAEVQLVQSGAEVKKPGASVKVSCKASGYTFTSYGISWVRQAPGQGLEWLGWINPNSGDTVYSQKFQGRVTMTSDKSVSTAYMELSSLRSDDTAVYYCASPGKNYYYGMDVWGQGTLVTVSSGGGGSGGGGSGGGGSQPVLTQPPSASGTPGQRVTISCSGSSSNIGSNLIYWYQQLPGTAPKLLIYSNNQRPSGVPDRFSGSKSGTSASLAISGLRSEDEADYFCSAWDDSLGGEVFGTGTKVNVLGQPKAAPSAAAEQKLISEEDL

SEQ ID NO: 4130 - protein, 250 aa, Artificial Sequence
  Description of Artificial Sequence: Synthetic polypeptide
EVQLVQSGGGLVQPGRSLRLSCAASGFTFDDYAMHWVRQAPGKGLEWVSGISWNSGNIGYADSVKGRFTISRDNAKNSLYLQMNSLRAEDTALYYCAKDKSYYYGSGTSGGWFDPWGQGTLVTVSSGTGGSGGTGSGTGGSTDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKLEIKR

SEQ ID NO: 4131 - protein, 250 aa, Artificial Sequence
  Description of Artificial Sequence: Synthetic polypeptide
EVQLVQSGAEVRKPGASVKVSCKASGYTFTHYYMHWVRQAPGQGLEWMGIINPSGGSTTYAQKLQGRVTMTRDTSTSTVYMELSSLRSEDTAVYYCARDWGSNYVWGSYPKYWGQGTLVTVSSGTGGSGGTGSGTGGSTQSVLTQPPSVSAAPGQKVTISCSGSSSNIGSNTVNWYQQLPGTAPKLLIYSNNQRPSGIPDRFSGSKSGTSASLAISGLQSEDEADYYCAAWDDSLNGPVFGGGTKLTVLG

SEQ ID NO: 4132 - protein, 254 aa, Artificial Sequence
  Description of Artificial Sequence: Synthetic polypeptide
EVQLVESGPGLVKPSETLSLTCTVSGGSTYNHHWSWIRQPPGRGLEWIGYISYSGKSNYNPSLKSRVTISLEPSTTQFSLKLNSLTAADTAVYYCAREYRDDTNYYYYSLDVWGPGTLVTVSSGGGGSGGGGSGGGGSGGGSAQIQMTQSPSTLSASVGDRVTITCRASQSISSWLAWYQQKPGKAPNLLIYKASNLETGVPSRFSGSGSGTEFTLTITSLQPDDFATYYCQQYNSFPITFGQGTRLEIKRAAA

SEQ ID NO: 4133 - protein, 254 aa, Artificial Sequence
  Description of Artificial Sequence: Synthetic polypeptide
EVQLVESGPGLVKPSEALSLTCTVSGGSTYNHHWSWIRQPPGRGLEWIGYISYSGKSNYNPSLKSRVTISLEPSTTQFSLKLNSLTAADTAVYYCAREYRDDTNYYYYSLDVWGPGTTVTVSSGGGGSGGGGSGGGGSGGGSAQIQMTQSPSTLSASVGDRVTITCRASQSISSWLAWYQQKPGKAPKLLIYKASSLESGVPSRFSGSGSGTEFTLTISSLQPDDFATYYCQQYNSYPFTFGPGTKLEIKRAAA

SEQ ID NO: 4134 - protein, 254 aa, Artificial Sequence
  Description of Artificial Sequence: Synthetic polypeptide
EVQLVESGPRLVKPSETLSLTCTVSGGSTYNHHWSWIRQPPGRGLEWIGYISYSGKSNYNPSLKSRVTISLEPSTTQFSLKLNSLTAADTAVYYCAREYRDDTNYYYYSLDVWGPGTMVTVSSGGGGSGGGGSGGGGSGGGSAQIVMTQSPSTLSASVGDRVTITCRASQSIGSWLAWYQQKPGKAPKLLIYKASSLESGVPSRFSGSGSGTEFTLTISSLQPEDFATYYCQQYNNYSYTFGPGTKLEIKRAAA

SEQ ID NO: 4135 - protein, 254 aa, Artificial Sequence
  Description of Artificial Sequence: Synthetic polypeptide
QVQLVESGGGLVKPGGSLRLSCAASGFTFSDYYMSWIRQAPGKGLEWVSYVTSSGRTKYYADSVKGRFTISRDNAKNSLYLQMNSLRAEDTAVYYCARPQEASEAFDIWGQGTLVTVSSGGGGSGGGGSGGGGSGGGSAQSVLTQPPSVSAAPGQKVTISCSGSSSNIGNNYVSWYQQLPGTAPKLLIYDNDKRPSGIPDRFSGSKSGTSATLGITGLQTGDEADYYCGTWDTSLSAPYVFGTGTKVTVLGAAA

SEQ ID NO: 4136 - protein, 255 aa, Artificial Sequence
  Description of Artificial Sequence: Synthetic polypeptide
QVQLVESGGGLVKPGGSLRLSCAASGFTFSDYYMSWIRQAPGKGLEWVSYVTSSGRTKYYADSVKGRFTISRDNAKNSLYLQMNSLRAEDTAVYYCARPQEASEAFDIWGQGTMVTVSSGGGGSGGGGSGGGGSGGGSAQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGSYVFGTGTKLTVLGAAA

SEQ ID NO: 4137 - protein, 252 aa, Artificial Sequence
  Description of Artificial Sequence: Synthetic polypeptide
EVQLVESGGGLVKPGGSLRLSCAASGFTFSDYYMSWIRQAPGKGLEWVSYVTSSGRTKYYADSVKGRFTISRDNAKNSLYLQMNSLRAEDTAVYYCARPQEASEAFDIWGQGTLVTVSSGGGGSGGGGSGGGGSGGGSAQSVLTQPPSVSVAPGQTARITCGGNNIGSKSVHWYQQKPGQAPVLVVYDDSDRPSGIPERFSGSNSGNTATLTISRVEAGDEADYYCQVWDSSSDHSYVFGTGTQLTVLGAAA

SEQ ID NO: 4138 - protein, 227 aa, Artificial Sequence
  Description of Artificial Sequence: Synthetic polypeptide
EVQLVQSGAEVKKPGASVKVSCKASGYTFTDYHINWVRQAPGQGLEWMGWIHPNSGDTNYAQKFQGWVTMTRDTAISTAYMEVNGLKSDDTAVYYCARGGLEPRSVDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 4139 - protein, 242 aa, Artificial Sequence
  Description of Artificial Sequence: Synthetic polypeptide
QVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKSGRLVPRGSGHHHHHH

SEQ ID NO: 4140 - protein, 227 aa, Artificial Sequence
  Description of Artificial Sequence: Synthetic polypeptide
  MOD_RES (1)..(1): Any amino acid
XVQLVESGPALVKPTQTLTLTCSFSGFSLSTSGMSVSWIRQPPGKALEWLALIDWDDDTYYSSSLKTRLTISKDTSKSQVVLTMTNMDPVDTATYYCARTLRVSGDYVRDFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4141 - protein, 230 aa, Artificial Sequence
  Description of Artificial Sequence: Synthetic polypeptide
EVQLVQSGAEVKKPGESLKISCKGSGYSFSDYWIGWVRQMPGEGLEWMGIIYPASSEIRYSPSFQGLVTISRDKSINTASLQWSSLKASDTAIYYCARHASCSARSCYWGPVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 4142 - protein, 227 aa, Artificial Sequence
  Description of Artificial Sequence: Synthetic polypeptide
QVQLQESGPGLVKPSGTVSLTCAVSGGSISSSYWWSWVRQPPGKGLEWIGEIYHSGNTNYNPSLKSRVTISVDKSKNLFSLKLSSVTAADTAVYYCARVALFDILTGGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVELKTPT

SEQ ID NO: 4143 - protein, 233 aa, Artificial Sequence
  Description of Artificial Sequence: Synthetic polypeptide
EVQLVESGPGLVKPSDILSLTCAVSGYSISSNYYWGWIRQPPGKGLEWIGSIYHSGSTYYKPSLESRLGISVDTSKNQFSLKLSFVSAADTAVYYCARHVRSGYPDTAYYFDKWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCHHHHHH

SEQ ID NO: 4144 - protein, 226 aa, Artificial Sequence
  Description of Artificial Sequence: Synthetic polypeptide
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 4145 - protein, 220 aa, Artificial Sequence
  Description of Artificial Sequence: Synthetic polypeptide
SVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4146 - protein, 217 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAYVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 4147 - protein, 217 aa, Artificial Sequence
  Description of Artificial Sequence: Synthetic polypeptide
  MOD_RES (1)..(1): Any amino acid
XPVLTQPPSASGTPGQRVTISCSGSSSNIGSNTVSWYQQVPGTAPKLLIYGNNERPSGVPDRFSGSKSATSASLAISGLQSEDEADYYCAAWDDSLNGFWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 4148 - protein, 219 aa, Artificial Sequence
  Description of Artificial Sequence: Synthetic polypeptide
DIVMTQSPLSLPVSPGEPASISCRSSQSLLHGNGYNYLDWYLQKPGQSPRLLIYLGSNRASGVPDRFSGSGSGTDFTLKISRVEAEDVGVYYCMQALQTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4149 - protein, 240 aa, Artificial Sequence
  Description of Artificial Sequence: Synthetic polypeptide
EVQLVESGAEVKKPGSSVKVSCRASGTFYKYAINWVRQAPGQGLEWMGGIIPFFGTTNYAQKFQGRLTITADGSTNTAYMQLDSLRSEDTAVYYCAGPSITESHYCLDCAAKDYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCHHHHHH

SEQ ID NO: 4150 - protein, 216 aa, Artificial Sequence
  Description of Artificial Sequence: Synthetic polypeptide
QSVLTQPPSASGTPGQSVTISCSGSRSNIGGNTVNWYQHLPGMAPKLLIYSSNQRSSGVPDRFSGSKSGTSASLAISGLQSEDDADYYCASWDDSLNGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4151 - protein, 208 aa, Artificial Sequence
  Description of Artificial Sequence: Synthetic polypeptide
YELTQPPSVSVSPGQTVNITCSGDTLGDKYVCWYQQKPGQSPVLVIYQDTKRPSGIPERFSGSNSGDTATLTVSGTQAMDEADYYCQAWDSSSFVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPT

SEQ ID NO: 4152 - protein, 469 aa, Artificial Sequence [sequence omitted]

SEQ ID NO: 4153 - protein, 138 aa, Artificial Sequence
  Description of Artificial Sequence: Synthetic polypeptide
MELGLCWVFLVAILKGVQCEVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVS

SEQ ID NO: 4154 - protein, 450 aa, Artificial Sequence
  Description of Artificial Sequence: Synthetic polypeptide
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 4155 - protein, 453 aa, Artificial Sequence
  Description of Artificial Sequence: Synthetic polypeptide
QVQLVQSGAEVKMPGSSVKVSCKTSGVFFSSHAISWVRQAPGQGLEWMGGISPMFGTTHYAQKFQGRVTITADQSTTTAYMELTSLTSEDTAVYYCARDGAGSYYPLNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4156 - protein, 472 aa, Artificial Sequence
  Description of Artificial Sequence: Synthetic polypeptide
MDWTWRFLFVVAAATGVQCQVQLVQSGAEVKMPGSSVKVSCKTSGVFFSSHAISWVRQAPGQGLEWMGGISPMFGTTHYAQKFQGRVTITADQSTTTAYMELTSLTSEDTAVYYCARDGAGSYYPLNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4157 - protein, 456 aa, Artificial Sequence
  Description of Artificial Sequence: Synthetic polypeptide
QVQLVQSGAEVKKPGASVKVSCKTSGYSFSTYGVSWVRQAPGQGPEWVGWISAYTGITDYAQKFQGRVTLTTDATTATAFLDLRSLRPDDTATYFCARDKVQGRVEVGSGGRHDYWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4158 - protein, 128 aa, Artificial Sequence
  Description of Artificial Sequence: Synthetic polypeptide
QVQLVQSGAEVRKPGASVKVSCKASGYTFTRHGISWVRQAPGQGLEWMGWISAYTGDTDYAQKFQGRVTMTTDTSTNTAYMELRSLRSDDAAVYYCARLRLQGEVVVPPSQSNWFDPWGQGTLVTVSS

SEQ ID NO: 4159 - protein, 120 aa, Artificial Sequence
  Description of Artificial Sequence: Synthetic polypeptide
QVHLVQSGAEVRKPGASVKVSCKVSGYTLNELSIHWLRQAPGRGLEWMGSFDPEDGETIYAQKFQGRVTMTGDTSTDTAYLELTSLRSEDTALYYCARGWGAVTSPFDFWGQGTLVTVSS

SEQ ID NO: 4160 - protein, 123 aa, Artificial Sequence
  Description of Artificial Sequence: Synthetic polypeptide
QLQLQESGPRLVKPSETLSLTCSVSGVSISSSNYYWGWIRQPPGKGLEWIGTIYHSGSTYYNPSLKSRLIISVDTSKNQFYLQLTSLTAADSAVYYCATGGGFGWSQTYFGYWGQGTLVTASS

SEQ ID NO: 4161 - protein, 125 aa, Artificial Sequence
  Description of Artificial Sequence: Synthetic polypeptide
EVQLLESGGGLVQPGGSLRLSCAASGFSFSTYAMSWVRQAPGKGLEWVSGISGSGESTYYADSVKGRFTVSRDNSKNTLYLQMNSLRAEDTAVYYCAKQGDHIAWLLRGINFDYWGQGVLVTVSS

SEQ ID NO: 4162 - protein, 126 aa, Artificial Sequence
  Description of Artificial Sequence: Synthetic polypeptide
QVQLVQSGAEVKKPGSSVKVSCKASGGAFSNYAISWVRQAPGQGLEWMGGIIPIFGTTNYAQKFQGRVTITADKFTTIAYMELRSLRSEDTAVYYCARHGGVYYYGSASSGWFDPWGQGTLVTVSS

SEQ ID NO: 4163 - protein, 469 aa, Artificial Sequence
  Description of Artificial Sequence: Synthetic polypeptide
MDWTWRFLFVVAAATGVQSQVQLVQSGAEVKKPGSSVKVSCKASGGTLNNYAISWVRQAPGQGLEWMGGISPIFGTLNYAERFQGRVTITADVFTNTVYMELSSLRSEDTAVYFCARGCGYNCYYFDGWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4164 - protein, 472 aa, Artificial Sequence; identical to SEQ ID NO: 4156
  Description of Artificial Sequence: Synthetic polypeptide

SEQ ID NO: 4165 - protein, 476 aa, Artificial Sequence
  Description of Artificial Sequence: Synthetic polypeptide
MEFGLSWVFLVALLRGVQCQVQLVESGGGVVQPGRSLRLSCAASGFTFSRFGIHWVRQAPGKGLEWMAVIWYDGSNKFYADSVKGRFTISRDNSKNTVYLQMNSLRAEDTAVYYCAKDSRGYCSSIICFEGGLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4166 - protein, 123 aa, Artificial Sequence
  Description of Artificial Sequence: Synthetic polypeptide
QVQLVQSGAEVKKPGSSVKVSCKASGGTFSDNAISWVRQAPGQGLEWMGGIIPIFGKPNYAQKFQGRVTITADESTSTAYMDLRSLRSEDTAVYYCARDSDAYYYGSGGMDVWGQGTLVTVSS

SEQ ID NO: 4167 - protein, 456 aa, Artificial Sequence
  Description of Artificial Sequence: Synthetic polypeptide
QVQLVQSGAEVKKPGASVTVSCQVSGYTLTSYGLSWVRQAPGQGLEWVGWINTYDGQTKYVKKFQGRVTMTTHTGTNTAYMEMKSLRSDDTAVYYCARVEGVRGVMGFHYYPMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEAPHNHYTQKSLSLSPGK

SEQ ID NO: 4168 - protein, 122 aa, Artificial Sequence
  Description of Artificial Sequence: Synthetic polypeptide
EVQLVQSGPGLVKPSETLSLTCTVSGSSMRTHYWTWIRQPPGKGLEWIGNIYYSGSTDYNPSLKSRVTISVDTSKNQFSLKLSSVTAADTAVYFCARTKHFDILPGGVFDMWGRGTTVTVSS

SEQ ID NO: 4169 - protein, 120 aa, Artificial Sequence
  Description of Artificial Sequence: Synthetic polypeptide
QVQLQESGPGLVKPSETLSLTCTVSGSSMRTHYWTWIRQPPGKGLEWIGNIYYSGSTDYNPSLKSRVTISVDTSKNQFSLKLSSVTAADTAVYFCARTKHFDILPGGVFDMWGRGTTVSS

SEQ ID NO: 4170 - protein, 125 aa, Artificial Sequence
  Description of Artificial Sequence: Synthetic polypeptide
QVQLQESGPGLVKPSQTLSLTCAVSGGSISSRGYYWSWIRQPPGKGLEWIGYIFYTGGTDYNPSLKSRITISRDTPKNQISLNLSSVTAADTAVYYCARVVDGSSGYHHYYFDYWGQGTLVTVSS

SEQ ID NO: 4171 - protein, 128 aa, Artificial Sequence
  Description of Artificial Sequence: Synthetic polypeptide
RGQLVQSGGGVVQPGRSLRLSCAASGFVFNVFGIHWVRQAPGKGLEWLATISYDGLNKYYADSVKGRITISRDNSKNTLYLQMNSLRAEDTAVYYCVRDSEESTYYGDYMWVYNWFDLWGQGTLVTVS

SEQ ID NO: 4172 - protein, 460 aa, Artificial Sequence
  Description of Artificial Sequence: Synthetic polypeptide
EVQLLESGGGLVKPGQSLKLSCAASGFTFTSYGMHWVRQPPGKGLEWVAVISYDGSYKYYADSVQGRFTISRDNSKNTLYLQMNSLRAEDTAVYYCAKDSRLRSLLYFEWLSQGYFNPWGAGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPGTELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGEPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4173 - protein, 129 aa, Artificial Sequence
  Description of Artificial Sequence: Synthetic polypeptide
EVQLLESGGGLVKPGQSLKLSCAASGFTFTSYGMHWVRQPPGKGLEWVAVISYDGSYKYYADSVQGRFTISRDNSKNTLYLQMNSLRAEDTAVYYCAKDSRLRSLLYFEWLSQGYFNPWGAGTTLTVSS

SEQ ID NO: 4174 - protein, 129 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGSNKYYADSVQGRFTISRDNSKNTLYLQMNSLRAEDTAVYYCAKDTKLRSLLYFEWLSSGLLDYWGQGAMVTVSS

SEQ ID NO: 4175 - protein, 129 aa, Artificial Sequence
  Description of Artificial Sequence: Synthetic polypeptide
EVQLLESGGGLVKPGQSLKLSCAASGFSFSTYAMHWVRQPPGKGLEWVAVVSYDGNYKYYADTVQGRFTISRDNSKNTLYLQMNSLRAEDTAVYYCAKDSRLRSLLYFEWLSQGYFNPWGQGTTLTVSS

SEQ ID NO: 4176 - protein, 129 aa, Artificial Sequence
  Description of Artificial Sequence: Synthetic polypeptide
EVQLLESGGGLRKPGQSLKLSCAASGFSFSTYAMHWVRQPPGKGLEWVAVVSYDGNYKYYADSVQGRFTISRDNSKNTLYLQMNSLRAEDTAVYYCAKDSRLRSLLYFEWLSQGYFNPWGQGTTLTVSS

SEQ ID NO: 4177 - protein, 129 aa, Artificial Sequence
  Description of Artificial Sequence: Synthetic polypeptide
QVQLLETGGGLVKPGQSLKLSCAASGFTFTSYAMHWVRQPPGKGLEWVAVVSYDGNYKYYADSVQGRFTISRDNSKNTLYLQMNSLRAEDTAVYYCAKDSRLRSLLYFEWLSQGYFNPWGQGTTVTVSS

SEQ ID NO: 4178 - protein, 129 aa, Artificial Sequence
  Description of Artificial Sequence: Synthetic polypeptide
EVQLLESGGGLVKPGQSLKLSCAASGFTFTSYGMHWVRQPPGKGLEWVAVVSYDGNYKYYADSVQGRFTISRDNSKNTLYLQMNSLRAEDTAVYYCAKDSRLRSLLYFEWLSQGYFNPWGAGTTLTVSS

SEQ ID NO: 4179 - protein, 129 aa, Artificial Sequence
  Description of Artificial Sequence: Synthetic polypeptide
EVQLLESGGGLVKPGQSLKLSCAASGFTFTSYGMHWVRQPPGKGLEWVAVLSYDGNYKYYADSVQGRFTISRDNSKNTLYLQMNSLRAEDTAVYYCAKDSRLRSLLYFEWLSQGYFNPWGAGTTLTVSS

SEQ ID NO: 4180 - protein, 129 aa, Artificial Sequence
  Description of Artificial Sequence: Synthetic polypeptide
EVQLLESGGGLVKPGQSLKLSCAASGFTFTTYAMHWVRQPPGKGLEWVAVLSYDGNYKYYADSVQGRFTISRDNSKNTLYLQMNSLRAEDTAVYYCAKDSRLRSLLYFEWLSQGYFNPWGAGTTLTVSS

SEQ ID NO: 4181 - protein, 129 aa, Artificial Sequence
  Description of Artificial Sequence: Synthetic polypeptide
EVQLLESGGGLVKPGQSLKLSCAASGFTFTTYAMHWVRQPPGKGLEWVAVVSFDGNNRYYADSVQGRFTISRDNSKNTLYLQMNSLRAEDTAVYYCAKDSQLRSLLYFEWLSSGVLDYWGQGAMVTVSS

SEQ ID NO: 4182 - protein, 129 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGNNKYYADSVQGRFTISRDNSKNTLYLQMNSLRAEDTAVYYCAKDSKLRSLLYFEWLSSGLLDYWGQGAMVTVSS

SEQ ID NO: 4183 - protein, 129 aa, Artificial Sequence
  Description of Artificial Sequence: Synthetic polypeptide
EVQLLESGGGLVKPGQSLKLSCAASGFTFTTYAMHWVRQPPGKGLEWVAVVSYDGNNKYYADSVQGRFTISRDNSKNTLYLQMNSLRAEDTAVYYCAKDSKLRSLLYFEWLSSGLLDYWGQGAMVTVSS

SEQ ID NO: 4184 - protein, 129 aa, Artificial Sequence
  Description of Artificial Sequence: Synthetic polypeptide
EVQLLESGGGLVKPGQSLKLSCAASGFTFTSYGMHWVRQPPGKGLEWVAVVSYDGNYKYYADSVQGRFTISRDNSKNTLYLQMNSLRAEDTAVYYCAKDSKLRSLLYFEWLSQGYFNPWGAGTTLTVSS

SEQ ID NO: 4185 - protein, 129 aa, Artificial Sequence
  Description of Artificial Sequence: Synthetic polypeptide
EVQLLESGGGLVKPGQSLKLSCAASGFTFTSYAMHWVRQPPGKGLEWVAVVSYDGNYKYYADSVQGRFTISRDNSKNTLYLQMNSLRAEDTAVYYCAKDSRLRSLLYFEWLSQGYFNPWGQGTTLTVSS

SEQ ID NO: 4186 - protein, 129 aa, Artificial Sequence
  Description of Artificial Sequence: Synthetic polypeptide
QVQLLETGGGLVKPGQSLKLSCAASGFTFTSYAMHWVRQPPGKGLEWVAVVSYDGNYKYYADSVQGRFTISRDNSKNTLYLQMNSLRAEDTAVYYCAKDSRLRSLLYFEWLSQGYFNPWGQGTTLTVSS

SEQ ID NO: 4187 - protein, 129 aa, Artificial Sequence
  Description of Artificial Sequence: Synthetic polypeptide
EVQLLESGGGLVKPGQSLKLSCAASGFTFTSYAMHWVRQPPGKGLEWVAVVSYDGNYKYYADSVQGRFTISRDNSKNTLYLQMNSLRAEDTAVYYCAKDSQLRTLLYFEWLSQGYFNPWGQGTTLTVSS

SEQ ID NO: 4188 - protein, 129 aa, Artificial Sequence
  Description of Artificial Sequence: Synthetic polypeptide
EVQLLESGGGLVKPGQSLKLSCAASGFTFTSYAMHWVRQPPGKGLEWVAVVSYDGNYKYYADSVQGRFTISRDNSKNTLYLQMNSLRAEDTAVYYCAKDSRLRTLLYFEWLSQGYFDPWGQGTTLTVSS

SEQ ID NO: 4189 - protein, 452 aa, Artificial Sequence
  Description of Artificial Sequence: Synthetic polypeptide
QVQLVQSGAEVKKPGASVTVSCQVSGYTLTSYGLSWVRQAPGQGLEWVGWINTYDGQTKYVKKFQGRVTMTTHTGTNTAYMEMKSLRSDDTAVYYCARVEGVRGVMGFHYYPMDVWGQGTMVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKKVEPKSCDKTHTCPPCPAPELLGGPSVFLFPPKPKDTLMISRTPEVTCVWDVSHEDPEVKFNYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEAPHNHYTQKSLSLSPGK

SEQ ID NO: 4190 - protein, 122 aa, Artificial Sequence
  Description of Artificial Sequence: Synthetic polypeptide
EVQLLESGGGLVQPGGSLRLSCAASGFAFSSYGMSWVRQAPGKGLEWVSAFSGSGTSTYYADSVKGRFTISRDKSKNTLYLQMNSLRAEDTAIYYCAKPPGPYIVVAGLFENWGRGTLVTVS

SEQ ID NO: 4191 - protein, 118 aa, Artificial Sequence
  Description of Artificial Sequence: Synthetic polypeptide
EVQLVESGAEVKKPGASVKVSCKASGYTFSRYYIHWVRQAPGQELEWMGWINPDSGDTNYAQKFRGRVTMARDTSISTVYMELNSLRYDDTAVYFCARIIWSSSGMDVWGQGTTVTVS

SEQ ID NO: 4192 - protein, 122 aa, Artificial Sequence
  Description of Artificial Sequence: Synthetic polypeptide
EVQLVESGGGVVQPGRSLRLSCAASGFSFSNYAMHWVRQAPGKGLEWVALISFDGSDKYYADSVKGRFTMSRDNSKNTLYLQMNSLRAEDTAVYYCARDEPYCGGDCFAFDVWGQGTMVTVS

SEQ ID NO: 4193 - protein, 120 aa, Artificial Sequence
  Description of Artificial Sequence: Synthetic polypeptide
QVQLQESGPGLVKPSETLSLTCSVSGGSINYYYWSWIRQPPGKGLECIGYISDTGRTYYNPSLRSRVTISVDTSKNQFSLNLTSMTAADTAVYYCARDPTGSRQKNAFDMWGQGTMVTVS

SEQ ID NO: 4194 - protein, 123 aa, Artificial Sequence
  Description of Artificial Sequence: Synthetic polypeptide
EVQLVESGGGLVQPGRSLRLSCVGSGFNFDGYAMQWVRQVPGKGLEWVSGISWHSDSTGYADSVRGRFTISRDNAKNSLYLQMDSLRPEDTAFYYCGKSIGHVGGSYRHPIDYWGQGTLVTVS

SEQ ID NO: 4195 - protein, 126 aa, Artificial Sequence
  Description of Artificial Sequence: Synthetic polypeptide
EVQLVESGAEVKKPGASVKVSCKASGYTFTSFDINWVRQAPGQGLEWMGWMTPTSGKTGYAQKFQGRITMTRNTSINTAYMELSSLRSEDTAVYFCARGPERRTTIFDVILDWFDPWGQGTLVTVS

SEQ ID NO: 4196 - protein, 118 aa, Artificial Sequence
  Description of Artificial Sequence: Synthetic polypeptide
EVQLLESGGGVVQPGRSLRLSCAASGFTFRTYGMHWVRQAPGKGLEWVAVISHDGNLKYYGGSVKGRFTISRDNSKNALYLQMNSLRVDDTALYYCARGIGITDAFDIRGQGTMVVVS

SEQ ID NO: 4197 - protein, 123 aa, Artificial Sequence
  Description of Artificial Sequence: Synthetic polypeptide
EVQLVESGAEVKKPGSSVKVSCKASGGTFRSYAVSWVRQAPGQGLEWMGGIIAIFGTTNYAQKFQDRVTITADDLPSTAYMELTSLRSEDTAVYFCVRGRGYYLGGDYGSLDSWGQGTLVTVS

SEQ ID NO: 4198 - protein, 119 aa, Artificial Sequence
  Description of Artificial Sequence: Synthetic polypeptide
EVQLVESGAGVKKPGSSVKVSCKASGNTFSSNAISWVRQAPGQGLEWMGGILGMLRTTNYAQKFQGRVTITADEFMNTAYMELSSLTSEDTAVYYCARSSGYYPDYFHLWGQGTLVTVS

SEQ ID NO: 4199 - protein, 471 aa, Artificial Sequence
  Description of Artificial Sequence: Synthetic polypeptide
MGWSWIFLLSVTAGVHSQVQLQQSGAELVRPGTSVKMSCKAAGYTFTNYWIGWVKQRPGHGLEWIGDIYPENDFSNYNEKFKDKATLTADTSSRTAYMQLSSLTSEDSAIYYCVRANEGWYLDVWGTGTTVSVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPTSTINPCPPCKECHKCPAPNLEGGPSVFIFPPNIKDVLMISLTPKVTCVVVDVSEDDPDVQISWFVNNVEVLTAQTQTHREDYNSTIRVVSALPIQHQDWMSGKEFKCKVNNKDLPAPIERTISKIKGIVRAPQVYILSPPPEQLSRKDVSLTCLAVGFSPEDISVEWTSNGHTEENYKNTAPVLDSDGSYFIYSKLDIKTSKWEKTDSFSCNVRHEGLHSYYLKKTISRSPGK

SEQ ID NO: 4200 - protein, 268 aa, Artificial Sequence
  Description of Artificial Sequence: Synthetic polypeptide
MDSRLNLVFLVLILKGVQCDVQLVESGGGLVQPGGSRKLSCAASGFTFSSFGMHWVRQAPEKGLEWVAYISSGSSTIYYADTVKGRFTISRDNPKNTLFLQMTSLRSEDTAMYYCARNYDEDFDVWGAGTTVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIF

SEQ ID NO: 4201 - protein, 257 aa, Artificial Sequence
  Description of Artificial Sequence: Synthetic polypeptide
MAVLGLLFCLVTFPSCVLSQVHLEQSGPGLVQPSQSLSITCTVSGFSLTTYGVHWVRQSPGKGLEWLGVIWRGGSIDYNAAFISRLSISKDNSKSQVFFKMNSLQANDTAIYYCARNWGRYGYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIF

SEQ ID NO: 4202 - protein, 247 aa, Artificial Sequence
  Description of Artificial Sequence: Synthetic polypeptide
SKLATMETDTLLLWVLLLWVPGSWAQVQLQQSGPELKKPGETVKISCKASGYTFTNYGMNWVKQAPGKDLKWLGWINTDTGEPTYAEEFKGRFAFSLETSASTAYLEINNLKNEDAATYFCARNKKYEAWFTHWGQGTLVTVSSAKTTPPSVYPLAPGSAAQTNSMVTLGCLVKGYFPEPVTVTWNSGSLSSGVHTFPAVLQSDLYTLSSSVTVPSSTWPSQTVTCNVAHPASSTKVDKKIVPRDCG

SEQ ID NO: 4203 - protein, 125 aa, Artificial Sequence
  Description of Artificial Sequence: Synthetic polypeptide
EVQLVQSGGGLVQPGGSLRLSCAASGFTFSSYAMHWVRQAPGKGLEWVAVISYDGSNKYYADSVKGRFTISRDNSKNTLYLQMNSLRAEDTAVYYCARDFWVSYYYDSSAPPAIWGQGTMVTVSS

SEQ ID NO: 4204 - protein, 366 aa, Artificial Sequence
  Description of Artificial Sequence: Synthetic polypeptide
GAGGTGCAGCTGGTGCAGTCTGGGGCTGAGGTGCAGAACTCTGGGTCCTCGGTGAGGGTCTCCTGCAAACCTTCTGGAGGCACCTTCAACAACTATGCTATCAACTGGGTGCGACAGGCCCCTGGACAAGGACTTGAGTGGGTGGGAGGGATCAGCCCTATCTTTGGTTCAACAAACTACGCACAGAAGTTCCAGGGCAGAGTCACGATTACCGCGAACATATTCAAGAGCACAGTCTACATGGACCTGAACAGCCTGACATCTGAGGACACGGCCATATATTACTGTGCGAAAGGCCAGGGATACTACTACTATTACGCTATGGACGTCTGGGGCCAAGGCACCCTGGTCACCGTCTCCCCTGCC

SEQ ID NO: 4205 - protein, 369 aa, Artificial Sequence
  Description of Artificial Sequence: Synthetic polypeptide
CAGGTGCAGCTGGTGCAGTCTGGGGGAGGCGTGGTCCAGCCTGGGAGGTCCCTGAGACTCTCCTGTGCAGCCTCTGAATTCACCTTCAGAATGTATGCTACCCACTGGGTCCGCCAGGCTCCAGGCAAGGGGCTGGAGTGGGTGGCTCTTATCTCATATGATGGAAGTAATAAATACTATGCAGACTCCGTGAAGGGCCGATTCACCATCTCCAGAGACAATTCCATGAACACGGTGTATCTGCAAATGAACACCCTGAGACCTGAGGACACGGCTGTCTATTACTGTGCGAGAGATTTAGGAGGTTATTTCATAAGGGGCATTATGGACGTCTGGGGCCAAGGAACCCTGGTCACCGTCTCCTCAGCC

SEQ ID NO: 4206 - protein, 452 aa, Artificial Sequence
  Description of Artificial Sequence: Synthetic polypeptide
QCQLVESGGDVVQPGRSLRLSCAASGFTFNNYGMHWVRQAPGKGLEWVAVVWYDGLIKYYADSVKGRFTISRDNSKNTLYLQMNTLRAEDMGVYYCARDLQPPHSPYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4207 - protein, 462 aa, Artificial Sequence
  Description of Artificial Sequence: Synthetic polypeptide
QVQLVQSGAEVKKPGASVKVSCKTSGYTFTAYTIHWVRQAPGQRLEWMGWINAGNGHTKYSQRFKGRVTITRDTSARTTYMELRSLTSEDTALYFCARGPETYYYDKTNWLNSHPDEYFQHWGHGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4208 - protein, 462 aa, Artificial Sequence; identical to SEQ ID NO: 4207
  Description of Artificial Sequence: Synthetic polypeptide

SEQ ID NO: 4209 - protein, 455 aa, Artificial Sequence
  Description of Artificial Sequence: Synthetic polypeptide
QVQLVQSGPELKKPGSSVKLSCMATGGTFINYAFSWVRQAPGQGLEWLGGIIPVYGTSNHVEKLQGRVTITADASTNTAYMELSGLRFDDTAVYFCAASTATSGTYYAMRPFDFWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4210 - protein, 450 aa, Artificial Sequence
  Description of Artificial Sequence: Synthetic polypeptide
QVQLVQSGGGVVQPGRSLRLSCAASGFTFRSHAMHWVRQAPGKGPEWVALISYDEVNKFYADSVKGRFTISRDVSKNTVFLQMNSLSADDTAVYYCARGHSGSYRLFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4211 - protein, 459 aa, Artificial Sequence
  Description of Artificial Sequence: Synthetic polypeptide
QVQLVESGAEVKKPGASVKLSCTASGYNFAAYYIHWVRQAPGQGLEWMGWSNPNTGGANYAQDFQGRVTMTAVTSTSTAYMELSRLTSDDTALYFCARVPRDRLLTLYYESSTYGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4212 - protein, 454 aa, Artificial Sequence
  Description of Artificial Sequence: Synthetic polypeptide
QVQLVESGAEVKKFGASVKVSCKASGYTLIDYYMHWVRVAPGQGLEWMGWINPINGGTNYAQKFQGRVTMTRDTSINTAYMDLSSLRSDDTAMYYCTRGRPIGRNWEPRDKDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4213 - protein, 456 aa, Artificial Sequence
  Description of Artificial Sequence: Synthetic polypeptide
QVQLLESGGGVVRPGRSLRLACAGSGFTFSAYAMHWVRQAPGKGLEWVAHTSYDGRDSYYVDSVKGRFTISRDDSKNTLYLQMNSLRPEDTAVYYCAKVGPYTGYDDYNYYGMDVWGHGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4214 - protein, 451 aa, Artificial Sequence
  Description of Artificial Sequence: Synthetic polypeptide
QVQLVESGGGVVQPGRSLRLSCAASGFTFTNYAMHWVRQAPGKGLEWVAVISFDEDNKSYADYVKGRFTISRDNSNNRLYLQMNSLRAEDTAVYYCARGPEGVWGRSIDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4215 - protein, 452 aa, Artificial Sequence
  Description of Artificial Sequence: Synthetic polypeptide
QVQLVQSGGGVVQPGRSLRLSCAASGFNFSSYGMHWVRQAPGKGLEWLSVIWSGGSNKYYADSVKGRFTISRDDSKNTVYLQMNSLRDEDTAVYYCARAHTALTRFRWLDPWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4216 - protein, 450 aa, Artificial Sequence
  Description of Artificial Sequence: Synthetic polypeptide
QVQLVESGGGLVQPGGSLRLSCAASGFIFGDFAIHWVRQASGKGLEWVARIRSGLNRFETAYAASVEGRLTISRDDSKSMAYLQMNNVKAEDTAVYLCTYLVGAVGFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4217 - protein, 456 aa, Artificial Sequence
  Description of Artificial Sequence: Synthetic polypeptide
QVQLVESGGGVVQPGGSLRLSCAASGFNFDEYVMYWVRQSPGKGLEWVSLIGADGRGTYNSDSVKGRFTISRDNRKNSLYLQMNSLRSDDTALYYCAKVERSFYDGSGYGDALEIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4218 - protein, 458 aa, Artificial Sequence
  Description of Artificial Sequence: Synthetic polypeptide
QVQLVESGPGLMKPSETLSLTCTVSGGSVSNYYWSWIRQPPGKGLEWIGYVFYSGSSNYNPSLNNPSLKSRVTISIDTSNNQFSLKLSSVTAADTAVYYCARGRVNSGYDWGPNFDSWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4219 - protein, 460 aa, Artificial Sequence
  Description of Artificial Sequence: Synthetic polypeptide
QVQLLESGPGLVKPSQTLLLTCTVSGASISTGGNYWSWIRQHPGKDLEWIGYIFYSGTTKYNPSVDNPSLKSRVTMSVDTSENQFSLKLSSVTAADTAVYFCARGSPNSGYDWGPHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4220 - protein, 458 aa, Artificial Sequence
  Description of Artificial Sequence: Synthetic polypeptide
QVQLVQSGAEVKKPGSSVKVSCKASGGTFSYYAISWVRQAPGQGLEWMGGIIPIVGTAHYTQKFQGRVTITADESTSTAYMELSSLRSEDTAVYFCARAADESVESLTIKAFRTNYHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4221 - protein, 457 aa, Artificial Sequence
  Description of Artificial Sequence: Synthetic polypeptide
QVQLVQSGAEVRKPGESLRISCRGSGYNFPKYWIGWVRQMPGKGLEWMGMIYPGDSDVRYNPSFQGQVTISADESINTAYLQWSSLRTSDTARYYCARHLGQQLVSNTYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4222 - protein, 221 aa, Artificial Sequence
  Description of Artificial Sequence: Synthetic polypeptide
DIVLTQSPLSLPVTPGEPASISCRSSQSLLDSNGYNYLDWYLQKPGQSPQLLIYLASYRAPGVPDRFSGSGSGTDFTLKISRVEAEDVGLYYCMQALQTPPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4223 - protein, 215 aa, Artificial Sequence
  Description of Artificial Sequence: Synthetic polypeptide
DIVMTQSPGTLSLSPGERATLYCRASQSVRSGYLAWYQHKPGQAPLLLFYDASGRATGIPDRFSGSGSGTDFTLTISRLEPEDFAVYYCLQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4224 - protein, 216 aa, Artificial Sequence
  Description of Artificial Sequence: Synthetic polypeptide
DIVLTQSPSASGSPGQSVTISCTGTSSDVGGYDYVSWYQQHPGKAPKLMIYEVRKRPSGVPDRFSGSKSGNTASLTVSGLQAEDEAYYYCASYAGTYIHLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVVPAECS

SEQ ID NO: 4225 - protein, 214 aa, Artificial Sequence
  Description of Artificial Sequence: Synthetic polypeptide
DIVMTQPPATLSVSPGERATLSCGASQGLGSNLAWYQQKPGQAPRLLIYAASTRATGITARFSGSGSGTEFTLTINSLQSEDFALYYCQQYTYWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4226 - protein, 217 aa, Artificial Sequence
  Description of Artificial Sequence: Synthetic polypeptide
DIVLTQPPSVSVAPGQTATITCGGNYIGSKSVNWYQQRPGHAPVLVVYDDSDRPSGIPDRFSGSNSRSTATTATLTISRVEAGDEADYYCQVWETSEDLWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVVPAECS

SEQ ID NO: 4227 - protein, 215 aa, Artificial Sequence
  Description of Artificial Sequence: Synthetic polypeptide
DIVLTQSPSFLSASVGDRVTITCRASQLISSYFAWYQQKPGKPPKLLIYAASTLQSGVPSRFSGSGSGTQFSLTISSLQPEDFATYYCQQLNSYPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4228 - protein, 459 aa, Artificial Sequence
  Description of Artificial Sequence: Synthetic polypeptide
QVQLVESGGGLVQPGGSLRLSCTVSGFTFNSYAMNWVRQAPGKGLEWVSGIRGSGENTYYAETVKGRFTISRDNSKNTLYLEMNSLRAEDTAVYYCARKWGRMTVFGVATDQLYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4229 - protein, 451 aa, Artificial Sequence
  Description of Artificial Sequence: Synthetic polypeptide
QVQLVESGGGLVQPGGSLRLSCVASGFTFSRFSMNWVRQAPGMGLEWVSYISDTGRTIYYADSVKGRFTISRDNDKNTLYLQMKSLRDEDSAFYYCARDPDTPFVRAFDSWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4230 - protein, 215 aa, Artificial Sequence
  Description of Artificial Sequence: Synthetic polypeptide
DIVMTQSPSFLSASVGDRVTITCRTSQVISSYLAWYQQRPGKAPKLLIYAASTLQSGVPSRFSGSGSGTRFSLTISNLQPEDFATYFCQQLTTYPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4231 - protein, 459 aa, Artificial Sequence
  Description of Artificial Sequence: Synthetic polypeptide
QVQLVESGPGLVKPSQTLSLTCTVSGGSISNGGYHWSWIRQHPGKGLEWIGNIYYRGSTFYDPSLKSRVTISVDTSKSQFSLKLTSVTAADTAVYYCARMPLANYDLLTGLYIGAFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4232 - protein, 453 aa, Artificial Sequence
  Description of Artificial Sequence: Synthetic polypeptide
QVQLVESGAEVRKPGESLRISCKAHGDSFTSYWIGWVRQLPGKGLEWMAVIYPRDSETKFSPAFHGQVSISVDKSTSTVHLQWNSLKASDTAVYYCARSPGYSGYLYGWFDPWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4233 - protein, 459 aa, Artificial Sequence
  Description of Artificial Sequence: Synthetic polypeptide
QVQLVESGAEVKKPGASVRVSCKGSGYTFTAYHMHWVRQAPGQGFEWVGWINPNSGATYYTSTFEGRVTMTRDTSITTAYMELSSLRSDDTAVYYCATDIVVERDASLGGFNSYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4234 - protein, 452 aa, Artificial Sequence
  Description of Artificial Sequence: Synthetic polypeptide
QVQLVESGGGLVQPGGSLRLSCAASGFTFSDYWMVWVRQAPGKGLVWVSRISSDGSTTSYADSVKGPFTISRDNAKNTLYLQMNSLRAEDTAVYYCARVATPYYYESGFDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4235 - protein, 453 aa, Artificial Sequence
  Description of Artificial Sequence: Synthetic polypeptide
QVQLVESGPGLVKPSETLSLTCTVSGDSVINSAYYWDWIRQPPGKGLEWVGSVYYSGITYYNPSLKSRVTISVDTSKNQFSLRLSYVTAADTALYYCARRGGGWQYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4236 - protein, 115 aa, Artificial Sequence
  Description of Artificial Sequence: Synthetic polypeptide
EVQLVESGGGLVQPGGSLRLSCAASGFTVSTYAMSWVRQTPEKRLEWVASMSSGGSLYYPDTVKGRFTISRDNSKNTVYLQMNSLRAEDTAMYYCVRGGYGTSYWGQGTLVTVSS

SEQ ID NO: 4237 - protein, 227 aa, Artificial Sequence
  Description of Artificial Sequence: Synthetic polypeptide
EVQLVESGGGLVQPGGSLRLSCAASGFTVSTYAMSWVRQTPEKRLEWVASMSSGGSLYYPDTVKGRFTISRDNSKNTVYLQMNSLRAEDTAMYYCVRGGYGTSYWGQGTLVTVSSDIVMTQTPLSLSVTPGEPASISCRSSQSIVHSIGDTYLEWYLQKPGQSPQLLIYKVSNRFSGVPDRFSGSGSGTDFTLKISRVEAEDVGIYYCFQGSHFPYTFGQGTKLEIK

SEQ ID NO: 4238 - protein, 115 aa, Artificial Sequence; identical to SEQ ID NO: 4236
  Description of Artificial Sequence: Synthetic polypeptide

SEQ ID NO: 4239 - protein, 115 aa, Artificial Sequence
  Description of Artificial Sequence: Synthetic polypeptide
EVQLVESGGGLVQPGGSLRLSCAASGFTVSTYAMSWVRQTPGKRLEWVASMSSGGSLYYPDTVKGRFTISRDTSKNTVYLQMNSLRAEDTAVYYCVRGGYGTSYWGQGTLVTVSS

SEQ ID NO: 4240 - protein, 115 aa, Artificial Sequence; identical to SEQ ID NO: 4239
  Description of Artificial Sequence: Synthetic polypeptide

SEQ ID NO: 4241 - protein, 115 aa, Artificial Sequence; identical to SEQ ID NO: 4239
  Description of Artificial Sequence: Synthetic polypeptide

SEQ ID NO: 4242 - protein, 115 aa, Artificial Sequence
  Description of Artificial Sequence: Synthetic polypeptide
EVQLVESGGGLVQPGGSLRLSCAASGFTVSTYAMSWVRQTPEKRLEWVASMSSGGSLYYPDTVKGRFTISRDNSKNIVYLQMNSLRAEDTAVYYCVRGGYGTSYWGQGTLVTVSS

SEQ ID NO: 4243 - protein, 115 aa, Artificial Sequence; identical to SEQ ID NO: 4242
  Description of Artificial Sequence: Synthetic polypeptide

SEQ ID NO: 4244 - protein, 115 aa, Artificial Sequence; identical to SEQ ID NO: 4242
  Description of Artificial Sequence: Synthetic polypeptide

SEQ ID NO: 4245 - protein, 115 aa, Artificial Sequence
  Description of Artificial Sequence: Synthetic polypeptide
EVQLLESGGGSVKPGGSLKLSCSASGFSLSTYAMSWVRQTPEKRLEWVASMSSGGSLYYPDTVKGRFTISRDTVKNIVYLQMSSLRSEDTAMYYCVRGGYGTSYWGQGTTVTVSS

SEQ ID NO: 4246 - protein, 129 aa, Artificial Sequence
  Description of Artificial Sequence: Synthetic polypeptide
QVQLVQSGAEVKKPGSSVTVSCKASGGTFSNYGISWVRQAPGQGLDWMGGIIPLFGTANYAQKFQGRVTITADESTSSSNMELSSLRSEDTAVYYCARDVHNYDFLTGYPLHLYGMDVWGQGTTVTVSS

SEQ ID NO: 4247 - protein, 125 aa, Artificial Sequence
  Description of Artificial Sequence: Synthetic polypeptide
QVQLQESGPGLVKPSQTLSLTCTVSGGSISSGTYYWSWIRHHPGKGLEWIGYIYHSGSAYYNPSLESRVTMSVDTSKNQFSLKLSSVTAADTAIYYCARAENLLSPYLAEGFDPWGQGTLVTVSS

SEQ ID NO: 4248 - protein, 125 aa, Artificial Sequence
  Description of Artificial Sequence: Synthetic polypeptide
EVQLVQSGAEVKKPGESLKISCQASGYSFTSRWIGWVRQMPGKGLEWVGFIYPSDSDVRYSPSFRGQVTISADKSISTAYLQWSSLKASDTAMYFCARLGGNKDYGDYLWYFDLWGRGALVTVSS

SEQ ID NO: 4249 - protein, 120 aa, Artificial Sequence
  Description of Artificial Sequence: Synthetic polypeptide
QVQLVQSGAEVKEPGSAMKVSCKASGGTFSSDAFCWVRQAPGRGLEWMGGIIPVFQTANYGPNFQGRVTISADVYTTTLYLELSGLTSEDTAVYFCARSGDGYNYYFPLWGQGTLVTVSS

SEQ ID NO: 4250 - protein, 129 aa, Artificial Sequence
  Description of Artificial Sequence: Synthetic polypeptide
QVQLQESGPGLVKPSETLSLICAVSGASISSSYWSWIRQPPGKGLEWIGYIYYSGVTKYNPSLKSRVTLSVDTSKNHFSLKLSYVTAADTAVYYCARNLPDIAVVTAVQDATPVWFDPWGPGTLVSVSS

SEQ ID NO: 4251 - protein, 127 aa, Artificial Sequence
  Description of Artificial Sequence: Synthetic polypeptide
WWQLVQSGAEVKKPGSSVKVSCKASGGTFSSYDISWVRQAPGQGLEWMGGIIPIYGTANYAQKFQGRVTITADESTSTAYMELSSLRSEDTAVYYCARAGGDSSGYYGALGRFFQHWGQGTLVTVSS

SEQ ID NO: 4252 - protein, 123 aa, Artificial Sequence
  Description of Artificial Sequence: Synthetic polypeptide
QFQLVQSGPEVKKPGTSVKVSCKASGYTSTTYGISWVRQVPGQGLEWMGWINPYNGNPHYGQKFQGRVTLTRDTSTNTAYLEILSLRSDDTAVYYCARDGWGQQLVPYYFDYWGQGTLVTVSS

SEQ ID NO: 4253 - protein, 125 aa, Artificial Sequence
  Description of Artificial Sequence: Synthetic polypeptide
QVQLVESGGGVVQPGRSLRLSCAASGFTFSSYGMHWVRQAPGKGLEWVAVIWYDGDNKYYGDSVKGRFTISRDNSKNTLFLQMNSLRAEDTAVYYCAKDTADHGDYVDLGFFDAWGQGTLVTVSS

SEQ ID NO: 4254 - protein, 129 aa, Artificial Sequence
  Description of Artificial Sequence: Synthetic polypeptide
EVQLVESGGGLVQPGRSLRLSCAASGFTFSDFWMSWVRQAPGKGLEWVANIDQDGNERFYADSVKGRFTISRDNAKNSLYLQMTSLRADDTAVYYCARDGREGYFYGSGSFYNLKGLNWGQGTLLTVSS

SEQ ID NO: 4255 - protein, 125 aa, Artificial Sequence
  Description of Artificial Sequence: Synthetic polypeptide
EVQLVQSGAELKMPGESLKISCKASGYTFTNYWIGWVRQTPGKGLEWMGIIFPPDSQTSYSPSFQGQVTFSVDNSISVAYIQWSSLKASDTAIYYCARSGIFDWSAPLVEAFDIWGQGTVVTVSS

SEQ ID NO: 4256 - protein, 125 aa, Artificial Sequence
  Description of Artificial Sequence: Synthetic polypeptide
EVQLVQSGAEVKKPGESLKISCKGSGYSFSDYWIGWVRQMPGEGLEWMGIIYPASSEIRYSPSFQGLVTISADKSINTASLQWSSLKASDTAIYYCARHASCSARSCYWGPVDYWGQGTLVTVSS

SEQ ID NO: 4257 - protein, 455 aa, Artificial Sequence
  Description of Artificial Sequence: Synthetic polypeptide
QVQLVQSGAELKRPGASVKVSCKTSGYSFNNYGINWVRQAPGQGLEWMGWISAYTGNTHYAKNFEGRVTLTTDTSTSTAYMEVRSLRSDDSAVYFCARAMIQGVVTLYLRPGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4258 - protein, 447 aa, Artificial Sequence
  Description of Artificial Sequence: Synthetic polypeptide
QVQLQESGPGLVKPSETLSLTCTVSGGLIGTGSYYWGWIRQTPGKGMEWIGSISYSGSTYYHPSLKSRVTISDDTSKNQLFLKLRSVTAADTAQYYCARYNWGIRYFDFWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKTRESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPAQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4259 - protein, 231 aa, Artificial Sequence
  Description of Artificial Sequence: Synthetic polypeptide
  MOD_RES (1)..(1): Any amino acid
XVQLVQSGGGVVQPRRSLRLSCAASGFTFSSYAMHWVRQAPGKGLEWVAVISYDGRNKYYADSVKGRFTVSRDNSKNTLYLQMNSLRAEDTSVYYCARELLMDYYDHIGYSPGPTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 4260 - protein, 247 aa, Artificial Sequence
  Description of Artificial Sequence: Synthetic polypeptide
  MOD_RES (1)..(1): Any amino acid
XVQLQESGGGLVQPGESLRLSCVGSGSSFGESTLSYYAVSWVRQAPGKGLEWLSIINAGGGDIDYADSVEGRFTISRDNSKETLYLQMTNLRVEDTGVYYCAKHMSMQQVVSAGWERADLVGDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCHHHHHH

SEQ ID NO: 4261 - protein, 227 aa, Artificial Sequence
  Description of Artificial Sequence: Synthetic polypeptide
  MOD_RES (1)..(1): Any amino acid
XVQLQQSGAEVKTPGASVKVSCKASGYTFTSFGVSWIRQAPGQGLEWIGWISAYNGDTYYAQKFQARVTMTTDTSTTTAYMEMRSLRSDDTAVYYCAREPPLFYSSWSLDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 4262 - protein, 230 aa, Artificial Sequence
  Description of Artificial Sequence: Synthetic polypeptide
QVQLVQSGAEVKKPGASVKLSCKASGYTFTAYSMHWVRQAPGQSLEWLGWINTAIGNTQYSQKFQDRVTITRDTSARTSYMELSSLRSGDTAVYFCARGASWDARGWSGYWGKGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCHHHHHH

SEQ ID NO: 4263 - protein, 234 aa, Artificial Sequence
  Description of Artificial Sequence: Synthetic polypeptide
QVQLVQSGAEVKKPGASVRVSCRASGYIFTESGITWVRQAPGQGLEWMGWISGYSGDTKYAQKLQGRVTMTKDTSTTTAYMELRSLRYDDTAVYYCARDVQYSGSYLGAYYFDYWSPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCHHHHHH

SEQ ID NO: 4264 - protein, 234 aa, Artificial Sequence; identical to SEQ ID NO: 4263
  Description of Artificial Sequence: Synthetic polypeptide

SEQ ID NO: 4265 - protein, 224 aa, Artificial Sequence
  Description of Artificial Sequence: Synthetic polypeptide
QVQLVQSGAEVKKPGSSVKVSCKSSGGTSNNYAISWVRQAPGQGLDWMGGISPIFGSTAYAQKFQGRVTISADIFSNTAYMELNSLTSEDTAVYFCARHGNYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4266 - protein, 231 aa, Artificial Sequence
  Description of Artificial Sequence: Synthetic polypeptide
QVQLVQSGAEVRKPGASVKVSCKASGYTFTDNYIHWVRQAPGQGLEWMGWIHPNSGATKYAQKFEGWVTMTRDTSISTVYMELSRSRSDDTAVYYCARAGLEPRSVDYYFYGLDVWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 4267 - protein, 220 aa, Artificial Sequence
  Description of Artificial Sequence: Synthetic polypeptide
EVLLVESGGDLVKPGGFLKLSCAASGFTFSSFGMSWVRHTPDKRLEWVATISNGGGYTYYQDSVKGRFTISRDNAKNTLFLEMTSLKSEDAGLYYCARRERYDEKGFAYWGRGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPR

SEQ ID NO: 4268 - protein, 219 aa, Artificial Sequence
  Description of Artificial Sequence: Synthetic polypeptide
QVQLVQSGGGVVQPGRSLRLSCAASEFTFRMYATHWVRQAPGKGLEWVALISYDGSNKYYADSVKGRFTISRDNSMNTVYLQMNTLRPEDTAVYYCARDLGGYFIRGIMDVWGQGTLVTVSSASTKGPSVFPLAPSSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 4269 - protein, 223 aa, Artificial Sequence
  Description of Artificial Sequence: Synthetic polypeptide
EVQLVESGAEVKKPGSSVKVSCKASGGTFITHVFTWVRQAPGQGLEWVGGFIAIFGTSNYAQKFQGRVTITADESTSTAYMELTSLTSEDTAVYYCARGISGSYGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4270 - protein, 226 aa, Artificial Sequence
  Description of Artificial Sequence: Synthetic polypeptide
EVQLVESGADMKPPGSSVKVPCKASGDTFSSYTITWVRQAPGQGLEWMGGITPIFGSPNYAQRFQDRVIITADESTSTAYMEVSNLRSEDTAVYFCARVGGEWGSGRYYLDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4271 - protein, 233 aa, Artificial Sequence
  Description of Artificial Sequence: Synthetic polypeptide
EVQLVESGGGVVQPGRSLRLSCAASGFMFSSYVMHWVRQPPGKGLEWVAVIWYDGSKTYFADSMRGRLTVSRDNSKNALYLQMNRLRAEDTAVYYCARQQDSGYSGPEVSYYSHYGMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4272 - protein, 230 aa, Artificial Sequence
  Description of Artificial Sequence: Synthetic polypeptide
EVQLVESGPALVKPTQTLTLTCSFSGFSLSTSGMSVSWIRQPPGKALEWLALIDWDDDTYYITYSSSLKTRLTISKDTSKSQVVLTMTNMDPVDTATYYCARTLRVSGDYVRDFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 4273 - protein, 226 aa, Artificial Sequence
  Description of Artificial Sequence: Synthetic polypeptide
QVQLVESGGGVVQPGRSLRLSCAASGFTFSTYAMHWVRQAPGKGLEWVAVISYDANYKYYADSVKGRFTISRDNSKNTLYLQMNSLRAEDTAVYYCAKDSQLRSLLYFEWLSQGYFDYWGQGTLVTVSSASTKGPSVFPLAPSSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 4274 - protein, 226 aa, Artificial Sequence
  Description of Artificial Sequence: Synthetic polypeptide
QVQLVQSGAEVKKPGASVTVSCQVSGYTLTSYGLSWVRQAPGQGLEWVGWINTYDGQTKYVKKFQGRVTMTTHTGTNTAYMEMKSLRSDDTAVYYCARVEGVRGVMGFHYYPMDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 4275 - protein, 123 aa, Artificial Sequence
  Description of Artificial Sequence: Synthetic polypeptide
EVQLQESGPGLVKPSGTLSLTCAVSGASLSSSDWWTWVRQPPGKGLEWIGEIHHGGSTNSNPSLQSRVTISIDKSKKQFSLKLTSVTVADTAIYYCARAPGADAGPYSENIHHWGQGTLVTVS

SEQ ID NO: 4276 - protein, 126 aa, Artificial Sequence
  Description of Artificial Sequence: Synthetic polypeptide
EVQLVESGPALVKPTQTLTLTCSFSGFSLSTSGMSVSWIRQPPGKALEWLALIDWDDDTYYITYSSSLKTRLTISKDTSKSQVVLTMTNMDPVDTATYYCARTLRVSGDYVRDFDLWGRGTLVTVS

SEQ ID NO: 4277 - protein, 456 aa, Artificial Sequence
  Description of Artificial Sequence: Synthetic polypeptide
EVQLVQSGGGVVQPRRSLRLSCAASGFTFSSYAMHWVRQAPGKGLEWVAVISYDGRNKYYADSVKGRFTVSRDNSKNTLYLQMNSLRAEDTSVYYCARELLMDYYDHIGYSPGPTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4278 - protein, 127 aa, Artificial Sequence
  Description of Artificial Sequence: Synthetic polypeptide
EVQLVQSGGAVVQPGRSLRLSCAASGFTFSIYAMHWVRQTPGKGLEWVALISYDGNNKYYADSVKGRFTISRDNYKNTLYLQMKGLRAEDTALYYCARRITEKGYYNDSGRPNWFDPWGQGTLVTVS

SEQ ID NO: 4279 - protein, 126 aa, Artificial Sequence
  Description of Artificial Sequence: Synthetic polypeptide
EVQLVESGGGVVQPGGSLRLSCIASAFNLGIFGMHWVRQAPGKGLEWVAFIRYDGGKTFYADSVKGRFTISRDNSKNTLYLQMNSLRTEDTALYYCARDATADYYGPGSYPNWLDPWGQGTLVTVS

SEQ ID NO: 4280 - protein, 119 aa, Artificial Sequence
  Description of Artificial Sequence: Synthetic polypeptide
EVQLVESGPVLVKPTETLTVTCTVSGFSVDNDRMGVSWIRQPPGKALEWLAHIFSNDEKSYSTSLRSRLTISKDTSKRQVVLSMTDMDPVDTATYYCARAPSEYAAMDVWGQGTMVTVS

SEQ ID NO: 4281 - protein, 448 aa, Artificial Sequence
  Description of Artificial Sequence: Synthetic polypeptide
EVQLQESGPGLVKPSQTLSLTCNVSGGSITGDYKWSWIRQPPGKGLEWIGHIHSTGTTYYNPSLRSRITISMDTSKNNLSLRLTSVTAADTAVYYCASHTLTSGHYPRDFDFWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSGK

SEQ ID NO: 4282 - protein, 122 aa, Artificial Sequence
  Description of Artificial Sequence: Synthetic polypeptide
QVQLQESGGGLVQPGGSLRLSCAASGFPFSSYVMIWVRQVPGKGLEWVSAIGGSGGSTYYADSVKGRFTISRDNSKNTLYLQMNSLRADDTAVYYCVLSPKSYYDNSGIYFDFWGKGTLVRV

SEQ ID NO: 4283 - protein, 98 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAK

SEQ ID NO: 4284 - protein, 108 aa, Artificial Sequence
  Description of Artificial Sequence: Synthetic polypeptide
LPELTQPPSVSVAPGKTARITCGGNNIGSKSVYWYQQKPGQAPVLVVYEDSDRPSGLPERFSGSNSGNTATLTISRVEAGDEADYYCQVWDSTSDHWVFGGRTKLTVL

SEQ ID NO: 4285 - protein, 96 aa, Artificial Sequence
  Description of Artificial Sequence: Synthetic polypeptide
SYVLTQPPSVSVAPGKTARITCGGNNIGSKSVHWYQQKPGQAPVLVIYYDSDRPSGIPERFSGSNSGNTATLTISRVEAGDEADYYCQVWDSSSDH

SEQ ID NO: 4286 - protein, 110 aa, Artificial Sequence
  Description of Artificial Sequence: Synthetic polypeptide
QAVLTQPPSASGTPGQRVTISCSGSSSNIGSYTVNWYQQLPGSAPKLLIYSNNHRPSGVPDRFSGSKSGTSASLAISGLQSEDEADYYCAAWADRQNWVFGGGTKLTVLG

SEQ ID NO: 4287 - protein, 98 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNG

SEQ ID NO: 4288 - protein, 122 aa, Artificial Sequence
  Description of Artificial Sequence: Synthetic polypeptide
EVQLVESGGGLVQPGGSLRLSCAASGFPFSSYVMIWVRQVPGKGLEWVSAIGGSGGSTYYADSVKGRFTISRDNSKNTLYLQMNSLRADDTAVYYCVLSPKSYYDNSGIYFDFWGQGTLVRV

SEQ ID NO: 4289 - protein, 112 aa, Artificial Sequence
  Description of Artificial Sequence: Synthetic polypeptide
NFMLTQPHSVSESPGKTITISCTASSGSIASNYVQWYQQRPGSAPITVIYEDNQRPSGVPDRFSGSIDTSSNSASLTISGLKTEDEADYYCQSYDNTNHWVFGGGTKVTVLG

SEQ ID NO: 4290 - protein, 98 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSN

SEQ ID NO: 4291 - protein, 122 aa, Artificial Sequence
  Description of Artificial Sequence: Synthetic polypeptide
EVQLVESGGGLVQPGGSLRLSCAASGFPFSSYVMIWVRQVPGKGLEWVSAIGGSGGSTYYADSVKGRFTISRDNSKNTLYLQMNSLRADDTAVYYCVLSPKSYYDNSGIYFDFWGRGTLVRV

SEQ ID NO: 4292 - protein, 112 aa, Artificial Sequence
  Description of Artificial Sequence: Synthetic polypeptide
QSVLTQPPSVSGAPGQRVTISCTGSSSNTGAGNHVHWYQQVAGAAPKLLISNNNNRPSGVPDRFSASKSGTSASLDITGLQAEDEADYYCQSYDNSLNDWVFGGGTKLTVLG

SEQ ID NO: 4293 - protein, 99 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSG

SEQ ID NO: 4294 - protein, 120 aa, Artificial Sequence
  Description of Artificial Sequence: Synthetic polypeptide
QVQLVQSGGGLVQPGGSLRLSCAASGFTLSTYGMHWVRQAAGKGLEWVAVSSYDGRNEYYADSVKGRFTISRDNFKDTLYLQMNNLRAEDTAVYYCAKEVGMRSYDSYGMDVWGKGTLVR

SEQ ID NO: 4295 - protein, 107 aa, Artificial Sequence
  Description of Artificial Sequence: Synthetic polypeptide
DIQLTQSPSTLSASVGGRVTITCRASQSIGPWLAWYQQKPGKAPELLIYEASSLESGVPSRFSGGGSGTEFTLTISRLQPDDIATYYCQQYSSPWTFGQGTKLEIKR

SEQ ID NO: 4296 - protein, 95 aa, Artificial Sequence
  Description of Artificial Sequence: Synthetic polypeptide
DIQMTQSPSTLSASVGDRVTITCRASQSISSWLAWYQQKPGKAPKLLIYDASSLESGVPSRFSGSGSGTEFTLTISSLQPDDFATYYCQQYNSYS

SEQ ID NO: 4297 - protein, 98 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAK

SEQ ID NO: 4298 - protein, 121 aa, Artificial Sequence
  Description of Artificial Sequence: Synthetic polypeptide
EVQLVESGGGVVQPGRSLRLSCAASGFTFSSYGMHWVRQAPGKGLEWVAHISYDGTETHYTDSVKGRFTISRDNSMETAYLQMDSLRAEDTAVYYCAKDVSLRAYDHYGMDVWGRGTLVRV

SEQ ID NO: 4299 - protein, 109 aa, Artificial Sequence
  Description of Artificial Sequence: Synthetic polypeptide
SSELTQDPAVSVALGQTVRITCQGESLRNYYANWYQQRPGQAPVLVIYGGNSRPSGIADRFSGSSSGITASLTITGAQAEDEADYYCDSRDSSDNHRVFGGRTQLTVLS

SEQ ID NO: 4300 - protein, 96 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSSGNH

SEQ ID NO: 4301 - protein, 121 aa, Artificial Sequence
  Description of Artificial Sequence: Synthetic polypeptide
QVQLVQSGGGVVQPGRSLRLSCGASGFTLSTYGMHWVRQAAGKGLEWVAVSSYDGRNEYYADSVKGRFTISRDNFKDTLYLQMNNLRAEDTAVYYCAKEVGMRSYDSYGMDVWGRGTLVRV

SEQ ID NO: 4302 - protein, 108 aa, Artificial Sequence
  Description of Artificial Sequence: Synthetic polypeptide
DIQLTQSPSSVSASVGDRVTITCRASQDINSWLAWYQQKPGEAPKVLFGAASSLQSGVPSRFSGSGSGTEFTLTISSLQAEDFATYYCQQSNNFPYTFGQGTKLEIKR

SEQ ID NO: 4303 - protein, 95 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQANSFP

SEQ ID NO: 4304 - protein, 120 aa, Artificial Sequence
  Description of Artificial Sequence: Synthetic polypeptide
EVQLVESGGGVVQPGRTLRLSCAASGFTFTSYGMHWVRQAPGKGLEWVAVISYDGRKKYYLDSVKGRFTISRDNSMETAYLQMDSLRPEDTAVYYCAKDVSLRAYDHYGMDVWGQGTLVR

SEQ ID NO: 4305 - protein, 108 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYFCQQSYSTPFTFGGGTKVDIKR

SEQ ID NO: 4306 - protein, 95 aa, Artificial Sequence
  Description of Artificial Sequence: Synthetic polypeptide
DIQMTQSPSSLSASVGDRVTITCRASQGISNYLAWYQQKPGKVPKLLIYAASTLQSGVPSRFSGSGSGTDFTLTISSLQPEDVATYYCQKYNSAP

SEQ ID NO: 4307 - protein, 455 aa, Artificial Sequence
  Description of Artificial Sequence: Synthetic polypeptide
EVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4308 - protein, 236 aa, Artificial Sequence
  Description of Artificial Sequence: Synthetic polypeptide
EVQLVESGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCHHHHHH

SEQ ID NO: 4309 - protein, 122 aa, Artificial Sequence
  Description of Artificial Sequence: Synthetic polypeptide
LEESGGGVVQPGRSLRLSCAASGFPFSSYGMHWVRQAPGKGLEWVAGVSYDGSYKYYADSVKGRFTISRDSSKSTLYLQMNSLRPEDTAVYYCARPSAIFGIYIILNGLDVWGQGTTVTVSS

SEQ ID NO: 4310 - protein, 127 aa, Artificial Sequence
  Description of Artificial Sequence: Synthetic polypeptide
QVKLLESGGGLVQPGGSLRLSCAASGITFSSYAMSWVRQAPGKGLEWVSTVNSGGGSTYYGDSVRGRFTISRDNSKSTLYLQLNSLRAEDTAIYYCAKDKGRPIFGLVTPSYYMDVWGNGTTVTVSS

SEQ ID NO: 4311 - protein, 10 aa, Artificial Sequence
  Description of Artificial Sequence: Synthetic peptide
GYTFTSFIMY

SEQ ID NO: 4312 - protein, 15 aa, Artificial Sequence
  Description of Artificial Sequence: Synthetic peptide
DPYNDGTKYNEKFEG

SEQ ID NO: 4313 - protein, 10 aa, Artificial Sequence
  Description of Artificial Sequence: Synthetic peptide
RGNYGNGFAY

SEQ ID NO: 4314 - protein, 113 aa, Artificial Sequence
  Description of Artificial Sequence: Synthetic polypeptide
WGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 4315 - protein, 456 aa, Artificial Sequence
  Description of Artificial Sequence: Synthetic polypeptide
  MOD_RES (219)..(219): Any amino acid
QVQLVQSGGELKKPGASVRVSCKASGYTFTTYGISWVRQAPGQGLEWVGWISAYTGNTDYAQKVQGRVTMTTDTSTSTAYMELRSLTSDDTAVYYCARDKVQGRVEAGSGGRHDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTXVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4316 - protein, 456 aa, Artificial Sequence
  Description of Artificial Sequence: Synthetic polypeptide
QVQLVQSGVEVKKPGASVKVSCKTSGYPFSTYGVSWVRQAPGQGLEWVGWISGYTGITDYAQKSQGRVTLTTDASTATAFLELRSLRPDDTATYFCARDKVQGRVEAGSGGRHDYWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4317 - protein, 456 aa, Artificial Sequence
  Description of Artificial Sequence: Synthetic polypeptide
QVQLVQSGAEVKKPGASVKVSCKTSGYSFSTYGVSWVRQAPGQGLEWVGWISGYTGITDYAQKFQGRVTLTTDATTATAFLELRSLRPDDTATYFCARDKVQGRVEVGSGGRHDYWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 4318 - protein, 464 aa, Artificial Sequence
  Description of Artificial Sequence: Synthetic polypeptide
MGWSLILLFLVAVATRVHSQVQLVQSGSELKKPGASVKMSCKAAGYTFTNYWIGWVRQAPGQGLEWIGDIYPENDFSNYNEKFKDRATLTADTSTRTAYMELSSLRSEDTAVYYCVRANEGWYLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4319 - protein, 464 aa, Artificial Sequence
  Description of Artificial Sequence: Synthetic polypeptide
MGWSLILLFLVAVATRVHSQVQLVQSGSELKKPGASVKVSCKAAGYTFTNYWIGWVRQAPGQGLEWIGDIYPENDFSNYNEKFKDRVTITADTSTSTAYMELSSLRSEDTAVYYCVRANEGWYLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 4320 - protein, 133 aa, Artificial Sequence
  Description of Artificial Sequence: Synthetic polypeptide
EVQLLESGGGLVKPGQSLKLSCAASGFTFTSYGMHWVRQPPGKGLEWVAVISYDGSYKYYADSVQGRFTISRDNSKNTLYLQMNSLRAEDTAVYYCAKDSELRSLLYFEWLSQGYFNPWGAGTTLTVSSASTK

SEQ ID NO: 4321 - protein, 133 aa, Artificial Sequence
  Description of Artificial Sequence: Synthetic polypeptide
EVQLLESGGGVVQPGRSLKLSCAASGFTFSSYGMHWVRQAPGKGLEWVAVISYDGSNKYYADSVEGRFTISRDNSKNTLYLQMNSLRAEDTAVYYCAKDGKLRSLLYFEWLSSGLLDYWGQGAMVTVSSASTK

SEQ ID NO: 4322 - protein, 133 aa, Artificial Sequence
  Description of Artificial Sequence: Synthetic polypeptide
EVQLLESGGGVVQPGRSLKLSCAASGFTFSSYGMHWVRQAPGKGLEWVAVVSYDGSNKYYADSVEGRFTISRDNSKNTLYLQMNSLRAEDTAVYYCAKDGKLRSLLYFEWLSSGLLDYWGQGAMVTVSSASTK

SEQ ID NO: 4323 - protein, 133 aa, Artificial Sequence
  Description of Artificial Sequence: Synthetic polypeptide
EVQLLESGGGVVQPGRSLKLSCAASGFTFSSYGMHWVRQAPGKGLEWVAVVSYDGSNKYYAPKFEGRFTISRDNSKNTLYLQMNSLRAEDTAVYYCAKDGKLRSLLYFEWLSSGLLDYWGQGAMVTVSSASTK

SEQ ID NO: 4324 - protein, 133 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGSNKYYADSVQGRFTISRDNSKNTLYLQMNSLRAEDTAVYYCAKDGKLRSLLYFEWLSSGLLDYWGQGAMVTVSSASTK

SEQ ID NO: 4325 - protein, 133 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGSNKYYADSVQGRFTISRDNSKNTLYLQMNSLRAEDTAVYYCGKDSQLRSLVYFEWLSSGLLDYWGQGAMVTVSSASTK

SEQ ID NO: 4326 - protein, 133 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGSNKYYADSVQGRFTISRDNSKNTLYLQMNSLRAEDTAVYYCAKDSQLRSLLYFEWLSSGLLDYWGQGAMVTVSSASTK

SEQ ID NO: 4327 - protein, 133 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGSNKYYADSVQGRFTISRDNSKNTLYLQMNSLRAEDTAVYYCAKDSKLRSLLYFEWLSSGLLDYWGQGAMVTVSSASTK

SEQ ID NO: 4328 - protein, 133 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGSNKYYADSVQGRFTISRDNSKNTLYLQMNSLRAEDTAVYYCAKDTQLRTIVYFEWLSQGFYDIWGQGAMVTVSSASTK

SEQ ID NO: 4329 - protein, 133 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGSNKYYADSVQGRFTISRDNSKNTLYLQMNSLRAEDTAVYYCAKDSQLRTIVYFEWLSQGYFDPWGQGAMVTVSSASTK

SEQ ID NO: 4330 - protein, 133 aa, Artificial Sequence
  Description of Artificial Sequence: Synthetic polypeptide
EVQLLESGGGLVKPGQSLKLSCAASGFTFSSYGMHWVRQPPGKGLEWVAVVSYDGSYKYYADSVQGRFTISRDNSKNTLYLQMNSLRAEDTAVYYCAKDSQLRSLLYFEWLSSGLLDYWGQGAMVTVSSASTK

SEQ ID NO: 4331 - protein, 133 aa, Artificial Sequence
  Description of Artificial Sequence: Synthetic polypeptide
EVQLLESGGGLVKPGQSLKLSCAASGFTFTSYGMHWVRQPPGKGLEWVAVISYDGSYKYYADSVQGRFTISRDNSKNTLYLQMNSLRAEDTAVYYCGKDSQLRSLIYFEWLSNGYFDIWGAGTTLTVSSASTK

SEQ ID NO: 4332 - protein, 133 aa, Artificial Sequence
  Description of Artificial Sequence: Synthetic polypeptide
EVQLLESGGGLVKPGQSLKLSCAASGFTFTSYGMHWVRQPPGKGLEWVAVISYDGSYKYYADSVQGRFTISRDNSKNTLYLQMNSLRAEDTAVYYCAKDSQLRSLLYFEWLSNGFYDIWGAGTTLTVSSASTK

SEQ ID NO: 4333 - protein, 133 aa, Artificial Sequence
  Description of Artificial Sequence: Synthetic polypeptide
EVQLLESGGGLVKPGQSLKLSCAASGFTFTSYGMHWVRQPPGKGLEWVAVISYDGSYKYYADSVQGRFTISRDNSKNTLYLQMNSLRAEDTAVYYCAKDSNLRTIVYFEWLSSGLLDYWGAGTTLTVSSASTK

SEQ ID NO: 4334 - protein, 133 aa, Artificial Sequence
  Description of Artificial Sequence: Synthetic polypeptide
EVQLLESGGGLVKPGQSLKLSCAASGFTFTSYGMHWVRQPPGKGLEWVAVISYDGSYKYYADSVQGRFTISRDNSKNTLYLQMNSLRAEDTAVYYCAKDSQLRTIVYFEWLSQGYFDPWGAGTTLTVSSASTK

SEQ ID NO: 4335 - protein, 133 aa, Artificial Sequence
  Description of Artificial Sequence: Synthetic polypeptide
EVQLLESGGGLVKPGQSLKLSCAASGFTFTSYGMHWVRQPPGKGLEWVAVISYDGSYKYYADSVQGRFTISRDNSKNTLYLQMNSLRAEDTAVYYCAKDTQLRTIVYFEWLSQGFYDIWGAGTTLTVSSASTK

SEQ ID NO: 4336 - protein, 115 aa, Artificial Sequence
  Description of Artificial Sequence: Synthetic polypeptide
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSS

SEQ ID NO: 4337 - protein, 120 aa, Artificial Sequence
  Description of Artificial Sequence: Synthetic polypeptide
EVQLVQSGAEVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSS

SEQ ID NO: 4338 - protein, 120 aa, Artificial Sequence
  Description of Artificial Sequence: Synthetic polypeptide
QVQLVQSGAGVKKPGSSMKVSCKASGSIFSNYGISWVRQAPGQGLEWMGGIIPIFGAANYAQKFQGRVTITADESTSTVYMEVRSLRSEDTAVYYCARRQQLYKGYYHHWGQGTLVTVSS

SEQ ID NO: 4339 - protein, 234 aa, Artificial Sequence
  Description of Artificial Sequence: Synthetic polypeptide
DIQMTQSPSSLSASLGERVSLTCRASQEISGYLSWLQQKPDGTIKRLIYAASTLDSGVPKRFSGSRSGSDYSLSISSLESEDFADYYCLQYANYPWSFGGGTKLEIKQIQLVQSGPELKKPGETVKISCKASGYTFTNYGMNWVKQAPGKGLKWMGWINIYSGESTYVDDFTGRFAFSLETSASTAYLQINNLKNEDMATYFCARSGDTMITAGRSFFAMDYWGQGTSVTVSSA

SEQ ID NO: 4340 - protein, 141 aa, Artificial Sequence
  Description of Artificial Sequence: Synthetic polypeptide
MEFGLSWIFLTAILKGVQCEVQLVESGGGLVKPGGSLRLSCAASGFTFSNALMSWVRQAPGKGLEWVGRIKSKTNGGTTDYAAPVKGRFTISRDDSKNTLYLQMNSLKTEDTAVYYCTTHLRYFDWLSDYWGQGTLVTVSS

SEQ ID NO: 4341 - protein, 146 aa, Artificial Sequence
  Description of Artificial Sequence: Synthetic polypeptide
MEFGLSWVFLVAILKGVQCEVQLVESGGGVVRPGGSLRLSCAASGFTFDDYGMSWVRQAPGKGLEWVSGINWNGGSTGYADSVKGRFTISRDNAKNSLYLQMNSLRAEDTALYYCARDRVTMVRGVIMDYYGMDVWGQGTTVTVSS

SEQ ID NO: 4342 - protein, 144 aa, Artificial Sequence
  Description of Artificial Sequence: Synthetic polypeptide
MKHLWFFLLLVAAPRWVLSQLQLQESGPGLVKPSETLSLTCTVSGGSISSSFYYCGWIRQPPGKGLEWIGSIYYRGSTYYNPSLKSRVTISVDTSKNQFSLKLSSVTAADTAVYYCARRVTMVRGVKGDYFDYWGQGTLVTVSS

SEQ ID NO: 4343 - protein, 119 aa, Artificial Sequence
  Description of Artificial Sequence: Synthetic polypeptide
QVQLQQSGPEVVRPGVSVKISCKGSGYIFTDYAMHWVKQSHAKSLEWIGVISTYTGKTNYSQKFKGKATMTVDKSSSTAYMELARLTSEDSSVYYCARRGDYDAWFAYWGQGTLVTVSA

SEQ ID NO: 4344 - protein, 119 aa, Artificial Sequence
  Description of Artificial Sequence: Synthetic polypeptide
QVQLVQSGAEVKKPGASVKVSCKASGYTFTDYAMHWVRQAPGQGLEWIGVISTYTGKTNYSQKFKGRATMTVDKSISTAYMELSRLRSDDTAVYYCARRGDYDAWFAYWGQGTLVTVSS

SEQ ID NO: 4345 - protein, 130 aa, Artificial Sequence
  Description of Artificial Sequence: Synthetic polypeptide
QVQLLQPGVELVRPGASVKLSCKASGYTFTSFWMNWVKQRPDQGLEWIGRIDPYDSETHYNQKFKDKAILTVDKSSSTAYMQLSSLTSEDSAVYYCGRGIATLMVLPDYWGQGTTVTESLEDPRVPSSNS

SEQ ID NO: 4346 - protein, 133 aa, Artificial Sequence
  Description of Artificial Sequence: Synthetic polypeptide
QVQLQQSGAELMKPGASVKISCKATGYTFSGHWIEWVKQRPGHGLEWIGEILPGSGNIHYNEKFKGKATFAADTSSNTAYMQLSSLTSEDSAVYYCARLGTTAVERDWYFDVWGQGTTVTESLEDPRVPSSNS

SEQ ID NO: 4347 - protein, 123 aa, Artificial Sequence
  Description of Artificial Sequence: Synthetic polypeptide
QVQLQQSGAELMKPGASVKISCKATGYTFSGHWIEWVKQRPGHGLEWIGEILPGSGNIHYNEKFKGKATFAADTSSNTAYMQLSSLTSEDSAVYYCARLGTTAVERDWYFDVWGQGTSVTVSS

SEQ ID NO: 4348 - protein, 120 aa, Artificial Sequence
  Description of Artificial Sequence: Synthetic polypeptide
QVQLQESGPDLVKPGASVKMSCKASGYSFTYYHMHWVKQTHGKSLEWIGRIPYNGGTNYSQRFKGKAVFTVDMSSSTAYMELRSLTSEDSAVYYCARDANYEGDWYFDVWGQGTTVTVSS

SEQ ID NO: 4349 - protein, 121 aa, Artificial Sequence
  Description of Artificial Sequence: Synthetic polypeptide
QVQLQESGPDLVKPGASVMISCKASGYSFTYYYMHWVKQSHGKTLEWIGRIYPYNGDTNYNRRFKDKAILTVDESSSTAYMELRSLTSEDSAVYFCARDANYEGDWYFDVWGQGTTVTVSS

SEQ ID NO: 4350 - protein, 129 aa, Artificial Sequence
  Description of Artificial Sequence: Synthetic polypeptide
QVQLVQSGGGVVQPGRSLRLSCVASGFTFSTYAMHWVRQAPGRGLEWVAVISYDGNYKYYADSVKGRFSISRDNSNSTLHLEMNTLRTEDTALYYCAKDSQLRSLLYFEWLSQGYFDPWGQGTLVTVTS

SEQ ID NO: 4351 - protein, 129 aa, Artificial Sequence
  Description of Artificial Sequence: Synthetic polypeptide
QVQLVQSGGGVVQPGRSLRLSCVASGFTFSTYAMHWVRQAPGRGLEWVAVISYDGNYKYYADSVKGRFSISRDNSNNTLHLEMNTLRTEDTALYYCAKDSQLRSLLYFEWLSQGYFDPWGQGTLVTVTS

SEQ ID NO: 4352 - protein, 129 aa, Artificial Sequence
  Description of Artificial Sequence: Synthetic polypeptide
QVQLVESGGGVVQPGRSLRLSCAASGFTFSTYAMHWVRQAPGKGLEWVAVISYDANYKYYADSVKGRFTISRDNSKNTLYLQMNSLRAEDTAVYYCAKDSQLRSLLYFEWLSQGYFDYWGQGTLVTVSS

SEQ ID NO: 4353 - protein, 129 aa, Artificial Sequence
  Description of Artificial Sequence: Synthetic polypeptide
QVQLVQSGGGVVQPGRSLRLSCVASGFTFSTYAMHWVRQAPGRGLEWVAVISYDANYKYYADSVKGRFSISRDNSQNTLHLEMNTLRTEDTALYYCAKDSQLRSLLYFEWLSQGYFEPWGQGTLVTVTS

SEQ ID NO: 4354 - protein, 129 aa, Artificial Sequence
  Description of Artificial Sequence: Synthetic polypeptide
EVQLVESGGGAVQPGESLKLSCAASGFTFSNYGMHWVRQAPGKGLEWVAVISYDGSNKYYADSVKGRFTISRDNSKDTLYLQMNSLRAEDTALFYCAKERPLRLLRYFDWLSGGANDYWGQGTLVTVSS

SEQ ID NO: 4355 - protein, 129 aa, Artificial Sequence
  Description of Artificial Sequence: Synthetic polypeptide
EVQLVESGGGAVQPGESLKLPCAASGFTFSNYGMHWVRQAPGKGLEWVAVISYDGSNKYYADSVKGRFTISRDNSKDTLYLQMNSLRAEDTALFYCAKERPLRLLRYFDWLSGGANDYWGQGTLVTVSS

SEQ ID NO: 4356 - protein, 119 aa, Artificial Sequence
  Description of Artificial Sequence: Synthetic polypeptide
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVS

SEQ ID NO: 4357 - protein, 122 aa, Artificial Sequence
  Description of Artificial Sequence: Synthetic polypeptide
QVQLQQSGPGLVKPSQTLSLTCTVSGGPVSGGGYSWNWIRQRPGQGLEWVGFMFHSGSPRYNPTLKSRITISVDTSKNLVSLKLSSVTAADTAVYFCARVGQMDKYYAMDVWGQGTTVTVSS

SEQ ID NO: 4358 - protein, 121 aa, Artificial Sequence
  Description of Artificial Sequence: Synthetic polypeptide
QVQLQESGPGLLKPSDTLALTCTVSGGSITSDYWSWIRQPPGRGLDWIGFFYNGGSTKYNPSLKSRVTISADTSKNQLSLKLTSVTAADTGVYYCARHDAKFSGSYYVASWGQGTRVTVSS

SEQ ID NO: 4359 - protein, 121 aa, Artificial Sequence
  Description of Artificial Sequence: Synthetic polypeptide
QVQLQESGPGLLKPSDTLALTCTVSGGSITSDYWSWIRQPPGRGLDWIGFFYNGGSTKYNPSLKSRVTISADTSKNQLSLKLTSVTAADTGVYYCARHDVKFSGSYYVASWGQGTRVTVSS

SEQ ID NO: 4360 - protein, 120 aa, Artificial Sequence
  Description of Artificial Sequence: Synthetic polypeptide
QVQLQESGPRVVRPSETLSLTCTVSGGSISSYNWIWIRQPPGKGLEWIGHIYDYGRTFYNSSLQSRPTISVDASKNQLSLRLTSVTASDTAVYYCARPLGILHYYAMDLWGQGTTVTVSS

SEQ ID NO: 4361 - protein, 118 aa, Artificial Sequence
  Description of Artificial Sequence: Synthetic polypeptide
EVQLVESGGGLVQPGGSLRLSCTASGLSVSSTYMNWVRQAPGKGLEWVSVFYSETRTYYADSVKGRFTVSRHNSNNTLYLQMNSLRVEDTAVYYCARVQRLSYGMDVWGQGTTVTVSS

SEQ ID NO: 4362 - protein, 118 aa, Artificial Sequence
  Description of Artificial Sequence: Synthetic polypeptide
EVQLVESGGGLVQPGGSLRLSCTASGLSVSSTYMNWVRQAPGKGLEWVSVFYSETRTYYADSVKGRFTVSRHNSNNTLYLQMNSLRAEDTAVYYCARVQRLSYGMDVWGQGTTVTVSS

SEQ ID NO: 4363 - protein, 120 aa, Artificial Sequence
  Description of Artificial Sequence: Synthetic polypeptide
QVQLQESGPGLVKPSETLSLTCSVSGGSISSDFWSWIRQPPGKGLEWIGYVYNRGSTKYSPSLKSRVTISADMSKNQFSLNMSSVTAADTAVYYCAKNGRSSTSWGIDVWGKGTTVTVSS

SEQ ID NO: 4364 - protein, 119 aa, Artificial Sequence
  Description of Artificial Sequence: Synthetic polypeptide
QVQLQESGPGLVKPSETLSLTCTVSGASISSDYWSWIRLPPGKGLEWIGYIYNRGSTKYTPSLKSRVTISLDTAENQFSLRLRSVTAADTAIYYCARHVGGHTYGIDYWGQGTLVTVSS

SEQ ID NO: 4365 - protein, 119 aa, Artificial Sequence
  Description of Artificial Sequence: Synthetic polypeptide
QVQLQESGPGLVKPSETLSLTCTVSGASISSDYWSWIRLPPGKGLEWIGYIYNRGSTKYTPSLKSRVTISLDTAENQFSLRLRSVTAADTAVYYCARHVGGHTYGIDYWGQGTLVTVSS

SEQ ID NO: 4366 - protein, 121 aa, Artificial Sequence
  Description of Artificial Sequence: Synthetic polypeptide
QVQLQESGPGLVKPSETLSVTCKVSGDSISSYSWSWIRQPPGKGLEWVGYLYYSGSTKYNPSLKSRTTISVDTSTNQLSLKLSFVTAADTAVYFCARTGSESTTGYGMDVWGQGTTVTVSS

SEQ ID NO: 4367 - protein, 119 aa, Artificial Sequence
  Description of Artificial Sequence: Synthetic polypeptide
QVQLQESGPRLVKPSESLSLTCTVSGGSISNSFWGWIRQPPGEGLEWIGYVYNSGNTKYNPSLKSRVTISRDTSKSQLYMKLRSVTAADTAVYYCARHDDASHGYSISWGHGTLVTVSS

SEQ ID NO: 4368 - protein, 107 aa, Artificial Sequence
  Description of Artificial Sequence: Synthetic polypeptide
DIQMTQSPSSLSASVGDRVTITCRASQTISTYLNWYQQKSGKAPKLLIYAASGLQSGVPSRFSGSGSGTDFTLTISSLQPEDFATYFCQQSYNTPLTFGQGTKVEIK

SEQ ID NO: 4369 - protein, 106 aa, Artificial Sequence
  Description of Artificial Sequence: Synthetic polypeptide
DIQMTQSPSSLSASVGDRVTITCRASQSISRYLNWYQQKPGKAPKLLIYGASTLQNGAPSRFSGSGSGTDFTLTISSLQPEDSATYLCQQSYSVPAFGGGTKVEVK

SEQ ID NO: 4370 - protein, 107 aa, Artificial Sequence
  Description of Artificial Sequence: Synthetic polypeptide
DIQMTQSPSSLSASVGDRVTISCRASQSISTYLNWYQQQPGKAPKVLISGATDLQSGVPSRFSGSGSGTDFTLTISSLQPEDFATYYCQQSYNTPLIFGQGTKLEIK

SEQ ID NO: 4371 - protein, 106 aa, Artificial Sequence
  Description of Artificial Sequence: Synthetic polypeptide
GIQMTQSPSSLSASVGDRVTITCRASQSISRYLNWYLQKPGKAPKLLISGASSLQSGVPSRFSGTGSGTEFTLTISSLQPEDFATYYCQQTFSIPLFGQGTKVEIK

SEQ ID NO: 4372 - protein, 123 aa, Artificial Sequence
  Description of Artificial Sequence: Synthetic polypeptide
QVQLQASGPGLVKPSETLSLTCTVSGDSITSGAYYWTWIRQHPGKGLEWIGYIYYSGNTYYNPSLKSRVTISLDTSKNQFSLKVNSVTAADTAVYYCARAASTSVLGYGMDVWGQGTTVTVSS

SEQ ID NO: 4373 - protein, 118 aa, Artificial Sequence
  Description of Artificial Sequence: Synthetic polypeptide
DMQLVESGGGLVPPGGSLRLSCAASGFSVSDNYINWVRQAPGKGLDWVSVFYSADRTSYADSVKGRFTVSSHDSKNTVYLQMNSLRAEDTAVYYCARVQKSYYGMDVWGQGTTVTVSS

SEQ ID NO: 4374 - protein, 124 aa, Artificial Sequence
  Description of Artificial Sequence: Synthetic polypeptide
EVQLVESGGGLVQPGGSLRLSCVASTFSLINYWMTWVRQAPGKGLEWVANIKQDGFEKYYVDSVKGRFTISRDNAKNSLYLQMNSLRVEDTAVYYCARQGSYADTYFYHYGMDVWGQGTTVTVS

SEQ ID NO: 4375 - protein, 124 aa, Artificial Sequence
  Description of Artificial Sequence: Synthetic polypeptide
EVQLVESGGGLVQPGGSLRLSCAASGFTFNSYWMTWVRQAPGKGLEWVANINQDGSEKFFVDSVKGRFTISRDNAKTSLYLQMNSLRVEDTAVYYCAREGAPYDTYYYYYAMDVWGQGTTVTVS

SEQ ID NO: 4376 - protein, 124 aa, Artificial Sequence
  Description of Artificial Sequence: Synthetic polypeptide
EVQLVESGGGLVQPGGSLRLSCAASEFNFKSYWMTWVRQAPGKGLEWVANINQDGSEKNYVDSVKGRFTISRDNAKNSLHLQMSSLRVDDTAVYYCARTGSSWDTYYYYYAMDVWGQGTTVTVS

SEQ ID NO: 4377 - protein, 124 aa, Artificial Sequence
  Description of Artificial Sequence: Synthetic polypeptide
EVQLVESGGGLVQPGGSLRLSCAASGFIFESYWMTWVRQAPGKGLEWVANIKQDGSEKNYVDSVKGRFTISRDNAKTSLYLQMNSLRAEDTAMYYCARSGSNWDTYYYYYGMDVWGQGTTVTVS

SEQ ID NO: 4378 - protein, 129 aa, Artificial Sequence
  Description of Artificial Sequence: Synthetic polypeptide
  MOD_RES (2)..(2): Any amino acid
MXEVQLVESGPVLVKPTETLTVTCTVSGFSVDNDRMGVSWIRQPPGKALEWLAHIFSNDEKSYSTSLRSRLTISKDTSKRQVVLSMTDMDPVDTATYYCARAPSEYAAMDVWGQGTMVTVSSYQGPSRE

SEQ ID NO: 4379 - protein, 126 aa, Artificial Sequence
  Description of Artificial Sequence: Synthetic polypeptide
EVQLQESGPGLVKPSQTLSLTCNVSGGSITGDYKWSWIRQPPGKGLEWIGHIHSTGTTYYNPSLRSRITISMDTSKNNLSLRLTSVTAADTAVYYCASHTLTSGHYPRDFDFWGQGTLVTVSSAGT

SEQ ID NO: 4380 - protein, 119 aa, Artificial Sequence; identical to SEQ ID NO: 4198
  Description of Artificial Sequence: Synthetic polypeptide

SEQ ID NO: 4381 - protein, 122 aa, Artificial Sequence
  Description of Artificial Sequence: Synthetic polypeptide
EVQLVQSGAEWKKPGSSVRVSCKASGPIFSSRSISWVRQAPGQGLEWMGGVIPIFGGPTVPQKFQGRLTMTADDSTSTAYMELNRLTSDDTAVYYCARTGYYSGSGTYAFDYWGQGTLVTVS

SEQ ID NO: 4382 - protein, 123 aa, Artificial Sequence
  Description of Artificial Sequence: Synthetic polypeptide
QVQLVQSGAEVKKPGSSVKVSCKASGGPFSMTAFTWLRQAPGQGLEWMGGISPIFRTPKYAQKFQGRVTITADESTNTANMELTSLKSEDTAVYYCARTLSSYQPNNDAFAIWGQGTMVTVSS

SEQ ID NO: 4383 - protein, 121 aa, Artificial Sequence
  Description of Artificial Sequence: Synthetic polypeptide
QVQLVQSGAEVKKPGSSVKVSCKAPGGIFNTNAFSWVRQAPGQGLEWVGGVIPLFRTASYAQNVQGRVTITADESTNTAYMELTSLRSADTAVYYCARSSGYHFRSHFDSWGLGTLVTVSS

SEQ ID NO: 4384 - protein, 120 aa, Artificial Sequence
  Description of Artificial Sequence: Synthetic polypeptide
QVQLVQSGAEVKKPGSSVKVSCKASGGTFSAYAFTWVRQAPGQGLEWMGGITGMFGTANYAQKFQGRVTITADELTSTAYMELSSLTSEDTALYYCARGLYYYESSLDYWGQGTLVTVSS

SEQ ID NO: 4385 - protein, 123 aa, Artificial Sequence; identical to SEQ ID NO: 4382
  Description of Artificial Sequence: Synthetic polypeptide

SEQ ID NO: 4386 - protein, 124 aa, Artificial Sequence
  Description of Artificial Sequence: Synthetic polypeptide
QVQLVQSGAEVKKPGSSVKVSCTSSEVTFSSFAISWVRQAPGQGLEWLGGISPMFGTPNYAQKFQGRVTITADQSTRTAYMDLRSLRSEDTAVYYCARSPSYICSGGTCVFDHWGQGTLVTVSS

SEQ ID NO: 4387 - protein, 108 aa, Artificial Sequence
  Description of Artificial Sequence: Synthetic polypeptide
KKPGSSVKVSCTSSEVTFSSFAISWVRQAPGQGLEWLGGISPMFGTPNYAQKFQGRVTITADQSTRTAYMDLRSLRSEDTAVYYCARSPSYICSGGTCVFDHWGQGTL

SEQ ID NO: 4388 - protein, 122 aa, Artificial Sequence
  Description of Artificial Sequence: Synthetic polypeptide
QVQLVQSGAEVKKPGASVKVSCKTSGVTFSSYAISWVRQAPGQGLEWMGGIIGVFGVPKYAQNFQGRVTITADKPTSTVYMELNSLRAEDTAVYYCAREPGYYVGKNGFDVWGQGTMVTVSS

SEQ ID NO: 4389 - protein, 126 aa, Artificial Sequence
  Description of Artificial Sequence: Synthetic polypeptide
QVQLVQSGAEVRKPGASVKVSCKASGYTFTGYYIHWVRQAPGQGLEWMGWINPMTGGTNYAQKFQVWVTMTRDTSINTAYMEVSRLTSDDTAVYYCARGASVLRYFDWQPEALDIWGLGTTVTVSS

SEQ ID NO: 4390 - protein, 108 aa, Artificial Sequence
  Description of Artificial Sequence: Synthetic polypeptide
QSVLTQPPSVSVAPGQTARITCGGNDIGRKSVHWNQQKPGQAPVLVVCYDSDRPSGIPERFSGSNSGNTATLTISRVEAGDEADYYCQVWDSSSDHVIFGGGTKLTVL

SEQ ID NO: 4391 - protein, 108 aa, Artificial Sequence
  Description of Artificial Sequence: Synthetic polypeptide
QSALTQPPSVSVAPGQTARITCGGNDIGRKSVHWNQQKPGQAPVLVVCYDSDRPSGIPERFSGSNSGNTATLTISRVEAGDEADYYCQVWDSSSDHVVFGGGTKLTVL

SEQ ID NO: 4392 - protein, 108 aa, Artificial Sequence
  Description of Artificial Sequence: Synthetic polypeptide
QSALTQPPSVSVAPGQTATITCGGNNIGRKRVDWFQQKPGQAPVLVVYEDSDRPSGIPERFSDSNSGTTATLTISRVEAGDEADYYCQVWDSDSDHVVFGGGTKLTVL

SEQ ID NO: 4393 - protein, 108 aa, Artificial Sequence
  Description of Artificial Sequence: Synthetic polypeptide
QSVLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVL

SEQ ID NO: 4394 - protein, 128 aa, Artificial Sequence
  Description of Artificial Sequence: Synthetic polypeptide
QIQLQESGPGLVKPSQTLSLTCAISGDSVSSNNAVWNWIRQSPSRGLEWLGRTYYRSKWYNDYAESVKSRITVNPDTSKNQFSLHLKSVTPEDTAVFYCVRSGHITVFGVNVDAFDMWGQGTMVTVSS

SEQ ID NO: 4395 - protein, 128 aa, Artificial Sequence
  Description of Artificial Sequence: Synthetic polypeptide
QVQLQESGPGLVKPSQTLSLTCAISGDSVSSNNAVWNWIRQSPSRGLEWLGRTYYRSKWYNDYAESVKSRITVNPDTSKNQFSLHLKSVTPEDTAVFYCVRSGHITVFGVNVDAFDMWGQGTMVTVSS

SEQ ID NO: 4396 - protein, 128 aa, Artificial Sequence; identical to SEQ ID NO: 4395
  Description of Artificial Sequence: Synthetic polypeptide

SEQ ID NO: 4397 - protein, 128 aa, Artificial Sequence
  Description of Artificial Sequence: Synthetic polypeptide
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITVFGLNIDAYDIWGQGAKVTVSS

SEQ ID NO: 4398 - protein, 128 aa, Artificial Sequence
  Description of Artificial Sequence: Synthetic polypeptide
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITVFGLNIDAYDIWGQGAMVTVSS

SEQ ID NO: 4399 - protein, 128 aa, Artificial Sequence
  Description of Artificial Sequence: Synthetic polypeptide
QVQLQQSGPGLVKPSQTLSLTCAISGDRVSSNSAVWNWIRQSPSRGLEWLGRTYYRSKWYYDYAESVKSRIVIDPDTSKNQVSLQLNSVTPEDSAIYYCARGGHITEFGLNIDAYDIWGQGAMVTVSS

SEQ ID NO: 4400 - protein, 128 aa, Artificial Sequence
  Description of Artificial Sequence: Synthetic polypeptide
QVQLQQSGPGLVKPSQTLSLTCVISGDTVSSNRATWNWMRQSPLRGLEWLGRTYYRSKWYNDYAVSVKSRVVINPDTSKNQVSLQLNTVTPDDSGVYFCARGGHITVFGVNIDAFDIWGLGTKVTVSS

SEQ ID NO: 4401 - protein, 128 aa, Artificial Sequence; identical to SEQ ID NO: 4400
  Description of Artificial Sequence: Synthetic polypeptide

SEQ ID NO: 4402 - protein, 128 aa, Artificial Sequence
  Description of Artificial Sequence: Synthetic polypeptide
QVELQQSGPGLVKPSQTLSLTCAISGDSVSSNSATWNWIRQSPSRGLEWLGRTYYRSKWYNDYADFLKRRITINPDTSNNEVSLRLTSVTPDDTALYYCARGGHITVFGVNIDAFDVWGQGTMATVSS

SEQ ID NO: 4403 - protein, 128 aa, Artificial Sequence
  Description of Artificial Sequence: Synthetic polypeptide
QVQLQQSGPGLVKPSQTLSLTCAISGDSVSSNSATWNWIRQSPSRGLEWLGRTYYRSKWYNDYADFLKRRITINPDTSNNEVSLRLTSVTPDDTALYYCARGGHITVFGVNIDAFDVWGQGTMVTVSS

SEQ ID NO: 4404 - protein, 128 aa, Artificial Sequence
  Description of Artificial Sequence: Synthetic polypeptide
QVQLQQSGPGLVKPSQTLSLTCAISGDSVSSYNAVWNWIRQSPSRGLEWLGRTYYRSGWYNDYAESVKSRITINPDTSKNQFSLQLNSVTPEDTAVYYCARSGHITVFGVNVDAFDMWGQGTMVTVSS

SEQ ID NO: 4405 - protein, 128 aa, Artificial Sequence; identical to SEQ ID NO: 4404
  Description of Artificial Sequence: Synthetic polypeptide

SEQ ID NO: 4406 - protein, 128 aa, Artificial Sequence; identical to SEQ ID NO: 4404
  Description of Artificial Sequence: Synthetic polypeptide

SEQ ID NO: 4407 - protein, 128 aa, Artificial Sequence
  Description of Artificial Sequence: Synthetic polypeptide
QVQLQQSGPGLVKPSQTLSLTCAISGDSVSSNNAVWNWIRQSPSRGLEWLGRTYYRSKWYNDYAESVKSRITINPDTSKNQFSLQLNSVTPEDTAVYYCARSGHITVFGVNVDAFDMWGQGTTVTVSS

SEQ ID NO: 4408 - protein, 128 aa, Artificial Sequence; identical to SEQ ID NO: 4407
  Description of Artificial Sequence: Synthetic polypeptide

SEQ ID NO: 4409 - protein, 128 aa, Artificial Sequence; identical to SEQ ID NO: 4407
  Description of Artificial Sequence: Synthetic polypeptide

SEQ ID NO: 4410 - protein, 125 aa, Artificial Sequence
  Description of Artificial Sequence: Synthetic polypeptide
EVQLVESGGGLVKPGGSLRLSCSASGFTFNIYAMNWVRQVPGKGLDWVSSISSRGDYIYYAESVEGRFTISRDNAKNSLYLEMNSLRAEDTAVYYCARAGLGTVDLRWGGAFDHWGKGILVTVSS

SEQ ID NO: 4411 - protein, 98 aa, Artificial Sequence
  Description of Artificial Sequence: Synthetic polypeptide
QVQLVQSGPEVKKPGASIKVSCRASGYTFSNYGITWVRQAPGQGLEWMGWISAYNGHTNSAQKFQGRVTMTTDTSTSTAYMEVRSLRSDDTAVYYCAR

SEQ ID NO: 4412 - protein, 122 aa, Artificial Sequence
  Description of Artificial Sequence: Synthetic polypeptide
QVQLVQSGPEVKKPGASIKVSCRASGYTFSNYGITWVRQAPGQGLEWMGWISAYNGHTNSAQKFQGRVTMTTDTSTSTAYMEVRSLRSDDTAVYYCARDRRDLLTGSLGDYWGQGTLVTVSS

SEQ ID NO: 4413 - protein, 97 aa, Artificial Sequence
  Description of Artificial Sequence: Synthetic polypeptide
QVQLVQSGAEVKRPGSSVTVSCKASGGSFTSFVISWVRQAPGQGLEWMGGVIPIFATPKYAQKFQGRLTITADKSTNTAYMELTSLRSEDTAMYYCA

SEQ ID NO: 4414 - protein, 125 aa, Artificial Sequence
  Description of Artificial Sequence: Synthetic polypeptide
QVQLVQSGAEVKRPGSSVTVSCKASGGSFTSFVISWVRQAPGQGLEWMGGVIPIFATPKYAQKFQGRLTITADKSTNTAYMELTSLRSEDTAMYYCASPDLTMVFVPHTGPLDFWGQGTLVTVSS

SEQ ID NO: 4415 - protein, 99 aa, Artificial Sequence
  Description of Artificial Sequence: Synthetic polypeptide
RLQLQESGPGLVKPSETLSLTCTVSGGSITSNTYYWGWIRQPPGKGLESIGSISFSGRTYYSPSLKSRVTMSVDTSKNQFSLKLSSVTAADTAFYYCAR

SEQ ID NO: 4416 - protein, 127 aa, Artificial Sequence
  Description of Artificial Sequence: Synthetic polypeptide
RLQLQESGPGLVKPSETLSLTCTVSGGSITSNTYYWGWIRQPPGKGLESIGSISFSGRTYYSPSLKSRVTMSVDTSKNQFSLKLSSVTAADTAFYYCARQLTGMVYAILLPSYFDFWGQGTLVTVSS

SEQ ID NO: 4417 - protein, 97 aa, Artificial Sequence
  Description of Artificial Sequence: Synthetic polypeptide
QVQLVQSGAEVKKPGSSVKVSCRASGGIFRSNAISWVRQAPGQGLEWMGEIIAVFGTANYAQKFQGRVTITADESTSTAYMELSSLRSEDTAVYYCA

SEQ ID NO: 4418 - protein, 132 aa, Artificial Sequence
  Description of Artificial Sequence: Synthetic polypeptide
QVQLQQSGAEVKKPGSSVKVSCKASGGTFNKYAINWVRQAPGKGLEWMGGIIPFFGTTNYAQKFQGRVTITADETTRTAYMELSSLRSEDTAVYYCARPSINESPYCLDCAAKDYYYGLDVWGQGTTVTVSS

SEQ ID NO: 4419 - protein, 132 aa, Artificial Sequence
  Description of Artificial Sequence: Synthetic polypeptide
QVQLVQSGAEVKKPGSSVTVSCKASGGSFSKYAINWVRQAPGQGLEWMGGIIPFFGTTNYAQKFQGRVTITADASTSTAYMALSSLSSEDTAVYYCARPSINESPYCLDCAAKDYYYGLDVWGQGTTVTVSS

SEQ ID NO: 4420 - protein, 132 aa, Artificial Sequence
  Description of Artificial Sequence: Synthetic polypeptide
QVQLVQSGAEVKKPGSSVKVSCKASGGTFSKYAINWVRQAPGQGLEWMGGIIPFFGTTNYAQKFQGRLTITADASTRTAYMELSSLRSEDTAVYYCARPSITETQYCLDCAAKDYYYGLDVWGQGTTVTVSS

SEQ ID NO: 4421 - protein, 132 aa, Artificial Sequence
  Description of Artificial Sequence: Synthetic polypeptide
QVQLVQSGAEVKKPGSSVKVSCKASGGTFSKYAINWVRQAPAQGLEWMGGIIPFFGTTNYAQKFQGRLTITADASTRTAYMELSSLRSEDTAVYYCARPSITESQYCLDCAAKDYYYGLDVWGQGTTVTVSS

SEQ ID NO: 4422 - protein, 132 aa, Artificial Sequence
  Description of Artificial Sequence: Synthetic polypeptide
EVQLVESGAEVKKPGSSVKVSCKASGGTFSKYAINWVRQAPGQGLEWMGGIIPFFGTTNYAQKFQGRLTITADASTRTAYMELSSLRSEDTAVYYCARPSITESQYCLDCAAKDYYYGLDVWGQGTMVTVSS

SEQ ID NO: 4423 - protein, 125 aa, Artificial Sequence
  Description of Artificial Sequence: Synthetic polypeptide
QVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSS

SEQ ID NO: 4424 - protein, 125 aa, Artificial Sequence
  Description of Artificial Sequence: Synthetic polypeptide
EVQLVESGGGVVQPGRSLRLSCAASGFAFHNRAMHWVRQAPGKGLEWVALIYFDGSKQYYADSVKGRFTISRDNSKNTVFLQMNSLRPEDTAVYYCAVPGPIFGIFPPWSYFDHWGQGILVTVSS

SEQ ID NO: 4425 - protein, 125 aa, Artificial Sequence
  Description of Artificial Sequence: Synthetic polypeptide
EVQLVQSGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 4426 - protein, 125 aa, Artificial Sequence
  Description of Artificial Sequence: Synthetic polypeptide
QVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 4427 - protein, 125 aa, Artificial Sequence
  Description of Artificial Sequence: Synthetic polypeptide
QVQLVESGGGVVQPGKSPRLSCAASGPTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 4428 - protein, 125 aa, Artificial Sequence
  Description of Artificial Sequence: Synthetic polypeptide
EVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSS

SEQ ID NO: 4429 - protein, 125 aa, Artificial Sequence
  Description of Artificial Sequence: Synthetic polypeptide
QVQLVQSGAELKRPGASVKVSCKTSGYSFNNYGINWVRQAPGQGLEWMGWISAYTGNTHYAKNFEGRVTLTTDTSTSTAYMEVRSLRSDDSAVYFCARAMIQGVVTLYLRPGDYWGQGTLVTVSS

SEQ ID NO: 4430 - protein, 125 aa, Artificial Sequence
  Description of Artificial Sequence: Synthetic polypeptide
QVQLVQSGAEVKQPGASVKVSCKASGYTFNAYYIHWVRQAPGQGLEWMGWINPNFGGTHYARKFQGRVTMTRDASINTAYMELDRLISDDTAVYYCVRWRAAAVIMDQFYKMDVWGQGTLVTVSS

SEQ ID NO: 4431 - protein, 120 aa, Artificial Sequence
  Description of Artificial Sequence: Synthetic polypeptide
QVQLQESGPGLVKPSETLSLTCTVSGGLIGTGSYYWGWIRQTPGKGMEWIGSISYSGSTYYHPSLKSRVTISDDTSKNQLFLKLRSVTAADTAQYYCARYNWGIRYFDFWGRGTLVTVSS

SEQ ID NO: 4432 - protein, 125 aa, Artificial Sequence; identical to SEQ ID NO: 4428
  Description of Artificial Sequence: Synthetic polypeptide

SEQ ID NO: 4433 - protein, 129 aa, Artificial Sequence; identical to SEQ ID NO: 4353
  Description of Artificial Sequence: Synthetic polypeptide

SEQ ID NO: 4434 - protein, 129 aa, Artificial Sequence; identical to SEQ ID NO: 4352
  Description of Artificial Sequence: Synthetic polypeptide

SEQ ID NO: 4435 - protein, 129 aa, Artificial Sequence; identical to SEQ ID NO: 4351
  Description of Artificial Sequence: Synthetic polypeptide

SEQ ID NO: 4436 - protein, 120 aa, Artificial Sequence
  Description of Artificial Sequence: Synthetic polypeptide
QVQLVQPGAEVKKPGSSVKVSCKASGGIFSPYAISWVRQAPGQGLEWMGGIIAIFGTTNYAQKFQGRVTITADKSTTTAYLELNSLRFEDTAVYYCARGGRYYVDYFDYWGQGTLVSVSS

SEQ ID NO: 4437 - protein, 122 aa, Artificial Sequence
  Description of Artificial Sequence: Synthetic polypeptide
QVHLVQSGAEVKKPGSSVRLSCSASGGPFSGFAISWLRQAPGQGLEWLGGISAVFGTATYAQKFQGRVTITADQFTSTSHMDLSRLTYDDTAVYYCARSGGYLPQNNWIDPWGQGTLVIVSS

SEQ ID NO: 4438 - protein, 127 aa, Artificial Sequence
  Description of Artificial Sequence: Synthetic polypeptide
EVQLLESGGGLVHPGGSLRLSCAASGFTFSNYAMSWVRQAPGKGLEWVSSINSGGGATYYADSVKGRFTISRDNSKNTLSLQMNSLRAEDTAVYYCAKEGGNTIFGLVTMAYYFDSWGQGTLVTVSS

SEQ ID NO: 4439 - protein, 127 aa, Artificial Sequence
  Description of Artificial Sequence: Synthetic polypeptide
QPQLQESGPGLVRPSETLSLTCTVSGDSVTRGGFYWGWIRQPPGKGLEWIGSIYYNYNIYHSPSLKSRVSLSVDTSKNQVSLKLASVTAADTAVYYCARHYPYYDLPTGFYSQFDFWGQGTPVTVSS

SEQ ID NO: 4440 - protein, 124 aa, Artificial Sequence
  Description of Artificial Sequence: Synthetic polypeptide
QVQLVQSGAEVKKPGSSVKVSCKASGGIFISQAISWVRQAPGQGLEWMGGIIPMFGATNYAQKFQGRVTITADKSTNTVYMELSSLTSEDTAVYYCARLGSGSYHNGPNWFDPWGQGTLVTVSS

SEQ ID NO: 4441 - protein, 129 aa, Artificial Sequence
  Description of Artificial Sequence: Synthetic polypeptide
QVQLVESGGGVVQPGRSLRLSCAVSGFTFSSYAMHWVRQAPGKGLEWVAVISYDGSNQYYADSVKGRFTISRDNSKNTLYLQMNSLRAEDTALYYCAKDPRLRHLLYFPFTSMIYFDYWGQGTLVTVSS

SEQ ID NO: 4442 - protein, 122 aa, Artificial Sequence
  Description of Artificial Sequence: Synthetic polypeptide
QGQLVQSGAEVKKSGSSVKVSCKTSGGTFNSHAISWVRQAPGQGLEWIGGIIPMFGTTNYAQKLKGRIAITADQLPTTAYLELSSLRSEDTAVYYCARGQRYYYDRDGMDVWGQGTMVTVSS

SEQ ID NO: 4443 - protein, 125 aa, Artificial Sequence
  Description of Artificial Sequence: Synthetic polypeptide
QVQLVQSGAEVKKPGSSVKVSCKASGVTSSNYPITWVRQAPGQGLEWMGGVLPLFGVTNYAQKFQGRVTISADKSTNTAYMELSSLRSEDTAVYYCARGKRPGYCSGGVCSSDYWGQGTLVTVSS

SEQ ID NO: 4444 - protein, 268 aa, Artificial Sequence; identical to SEQ ID NO: 4200
  Description of Artificial Sequence: Synthetic polypeptide

SEQ ID NO: 4445 - protein, 257 aa, Artificial Sequence; identical to SEQ ID NO: 4201
  Description of Artificial Sequence: Synthetic polypeptide

SEQ ID NO: 4446 - protein, 247 aa, Artificial Sequence; identical to SEQ ID NO: 4202
  Description of Artificial Sequence: Synthetic polypeptide

SEQ ID NO: 4447 - protein, 169 aa, Artificial Sequence
  Description of Artificial Sequence: Synthetic polypeptide
EENLLQSGGGLVQPGGSLRLSCAGSGFTFSTYAMTWVRQAPGQGLEWVSSISGSGEISYYADSVGLFTISRDNSKDTVFLQMTSLRAEDTAVYYCAKSDVWEGYRPSKDALHMWGQGTMVTVSSASTKGPSVFPLAPSSKSTSGGTAALGCLVKDYFPEPVTVSWNSGA

SEQ ID NO: 4448 - protein, 177 aa, Artificial Sequence
  Description of Artificial Sequence: Synthetic polypeptide
QVQLVQSGSELKKPGASVKVSCKASGYTFTSYSIYWVRQAPGQGLEWMGWINTNTGNPSYAQGFTGRFVFSFDTSVSTAYLEISSLKAEDTAVYYCAREGDYDILTGYYYYFDYWGQGTLVTVSSASTKGPSVFPLAPSSKSTSGGTAALGCLVKDYFPEPVTVSWNSGALTSGVHT

SEQ ID NO: 4449 - protein, 173 aa, Artificial Sequence
  Description of Artificial Sequence: Synthetic polypeptide
QVQLQESGPGLVKPLQTLSLTCVVSGDSISRGGYYWSWVRQPPERGLEWIGDIYHSGSTNYNPALKSRTTISVETSKNQFSLQLNSVTAADTAVYYCAREPPPDYSDYKVGKGYFDYWGQGALVTVSSASTKGPSVFPLAPSSKSTSGGTAALGCLVKDYFPEPVTVSWNSGA

SEQ ID NO: 4450 - protein, 175 aa, Artificial Sequence
  Description of Artificial Sequence: Synthetic polypeptide
QVKLVQSGGGAVQPGRSLRLSCEASGFDFTVYDIHWVRQAPGKGLEWVASIWHNGGKAYYADSVKGRFTVSRDNPQKTVYLQMSGLRPEDTATYYCAREFPFMGIYDYGMDAWGQGTTVTVASASTKGPSVFPLAPSSKSTSGGTAALGCLVKDYFPEPVTVSWNSGALTSGVHT

SEQ ID NO: 4451 - protein, 147 aa, Artificial Sequence
  Description of Artificial Sequence: Synthetic polypeptide
MKHLWFFLLLVAAPRWVLSQVQLVESGPGLVKPSETLSLTCTVSSGSISSYYWSWIRQPPGKGLEWIGYVYNSGSTRYNPSLKSRLTMSVDASRKQVSLKLSSVSAADTAVYYCARAPDDYYDSVGYYYGCPYFDSWGQGTLVTVSS

SEQ ID NO: 4452 - protein, 141 aa, Artificial Sequence
  Description of Artificial Sequence: Synthetic polypeptide
MEFGLSWVLLVALLRGVQCQVQLVESGGDVVQPGRSLRLSCAASGFTFNNYGMHWVRQAPGKGLEWVAVVWYDGLIKYYADSVKGRFTISRDNSKNTLYLQMNTLRAEDMGVYYCARDLQPPHSPYGMDVWGQGTTVTVSS

SEQ ID NO: 4453 - protein, 152 aa, Artificial Sequence
  Description of Artificial Sequence: Synthetic polypeptide
MEFGLSWLFLVAILKGVQCEVQLLESGGGLVQPGGSLRLSCAASGFTFSNYAMSWVRQAPGKGLEWVSAISGGGDWTYYADSVKGRFSISSDNSKNTLYLQMNSLRAEDTAVYYCAKDVTYLYDSSGYYYGGADRDYYFDYWGQGTLVTVSS

SEQ ID NO: 4454 - protein, 117 aa, Artificial Sequence
  Description of Artificial Sequence: Synthetic polypeptide
LESGGGLVQPGGSLRLSCAASGITFSSYAMSWVRQAPGKGLEWVSTVNSGGGSTYYGDSVRGRFTISRDNSKSTLYLQLNSLRAEDTAIYYCAKDKGRPIFGLVTPSYYMDVWGNGT

SEQ ID NO: 4455 - protein, 122 aa, Artificial Sequence; identical to SEQ ID NO: 4309
  Description of Artificial Sequence: Synthetic polypeptide

SEQ ID NO: 4456 - protein, 127 aa, Artificial Sequence
  Description of Artificial Sequence: Synthetic polypeptide
QVQLQQWGAGLLKPSETLSLTCTVSGGSLTDYSWNWIRQPPGKGLEWIGDTLHNGYTNYNPSLRGRVSISIDTSKNQVSLRLTSVTAADTALYYCARGSGGYGGFDYFGKLRTWDFWGQGTLVTVSS

SEQ ID NO: 4457 - protein, 119 aa, Artificial Sequence
  Description of Artificial Sequence: Synthetic polypeptide
EVQLVESGGGLVQPGGSLRLSCGASGISVSTSAMSWVRQVPGKGLEWVSGISGSGATTYYAGSVKGRFTISRDKSKNTLHLQMSRLRAEDTAIYYCAKDTSLFEYDTSGFTAPGNAFDI

SEQ ID NO: 4458 - protein, 111 aa, Artificial Sequence
  Description of Artificial Sequence: Synthetic polypeptide
QVQLQQSGAEVKTPGASVKVSCKASGYTFTRFGVSWIRQAPGQGLEWIGWISAYNGDTYYAQKFQARVTMTTDTSTTTAYMEMRSLRSDDTAVYYCAREPPLFYSSWSLDN

SEQ ID NO: 4459 - protein, 110 aa, Artificial Sequence
  Description of Artificial Sequence: Synthetic polypeptide
EVQLVESGGGLIQPGGSLRLSCAASGFTFSAYAMNWVRQAPGKGLEWVSAIGGSGGSTYYADSVKGRFTISRDNSKKILYLQMNGLRAEDTAIYYCAKGRDWTGGYFFDS

SEQ ID NO: 4460 - protein, 109 aa, Artificial Sequence
  Description of Artificial Sequence: Synthetic polypeptide
VQLVDSGGGLVQPGGSLRLSCAASGFAFSGYAMSWVRQAPGKGLEWVSDIGGSGGGTYYADSVKGRFTISRDNAKNTLYLQMNSLRAEDTAVYYCAKSSSWDRAYFFDS

SEQ ID NO: 4461 - protein, 112 aa, Artificial Sequence
  Description of Artificial Sequence: Synthetic polypeptide
QLQLQESGPGLVKPSETLSLTCTVSGGSIGSYYWSWIRQPPGKGLEWIGYIYYRGGTSYNPSLKSRVTISVDTSKSQFTLKLNSVTAADTAVYYCARKDWGSAAGSVWYFDL

SEQ ID NO: 4462 - protein, 111 aa, Artificial Sequence
  Description of Artificial Sequence: Synthetic polypeptide
EVQLVESGGGVVQPGRSLRLSCAASGFAFSSYGMHWVRQAPGKGLEWVTFIWYDGSNKHYADSMKGRFTISRDNSKNTLYLQMSSLRAEDTAVYYCARDGGYSTWEWYFDL

SEQ ID NO: 4463 - protein, 111 aa, Artificial Sequence
  Description of Artificial Sequence: Synthetic polypeptide
QVQLVQSGAEVKKPGASVKVSCQASGYTFTSFGLSWVRQAPGQGPEWMGWISAYNGEIKYAQKFQGRVSMTTDTSTRTAYMEVRSLRPDDTAVYYCAREPPLYFSSWSLDF

SEQ ID NO: 4464 - protein, 110 aa, Artificial Sequence
  Description of Artificial Sequence: Synthetic polypeptide
QVQLVQSGAEVKKPGASVKLSCKASGYTFTAYSMHWVRQAPGQSLEWLGWINTAIGNTQYSQKFQDRVTITRDTSARTSYMELSSLRSGDTAVYFCARGASWDARGWSGY

SEQ ID NO: 4465 - protein, 115 aa, Artificial Sequence
  Description of Artificial Sequence: Synthetic polypeptide
QVTLKESGPVLVKPKETLTLTCTVSGFSLSNTRMGVSWIRQPPGKALEWLAHIFSNDETSYRTSLKRRLTISQDISKSQVVLSMTNVDPADTATYFCARIGSGYESSAYSTWLDP

SEQ ID NO: 4466 - protein, 113 aa, Artificial Sequence
  Description of Artificial Sequence: Synthetic polypeptide
QVQLQQWGAGLLKPSETLSLTCAVYGGSFTDHYWSWIRQSPGKGLEWIGEVVHSGDTNYTPSLRNRVSISVDSSKNQFSLRLGSVTAADTAVYYCARGRNVAVVGAIQRHYDY

SEQ ID NO: 4467 - protein, 119 aa, Artificial Sequence
  Description of Artificial Sequence: Synthetic polypeptide
QVQLQESGPGLVKPSETLSLTCTVSGGSVSSGTYYWSWIRQPPGKGLEWIGDISYSGSTNYNPSLKSRVTISRDTSKNLVSLKLTSVTAADTAVHYCARAMAAYNYDRGGYNDYYYMDV

SEQ ID NO: 4468 - protein, 111 aa, Artificial Sequence
  Description of Artificial Sequence: Synthetic polypeptide
EVQLVESGGGVVQPGRSLRLSCAASGFSFTTYGMHWVRQAPGKGLEWVAFIWYDGSNKHYQDSVKGRFTISKDNSNNMLYLQMDSLRVADTAVYYCVRDGGYSTWEWYFDL

SEQ ID NO: 4469 - protein, 116 aa, Artificial Sequence
  Description of Artificial Sequence: Synthetic polypeptide
EVQLVESGGGLVQPGGSLRLSCAASGFTDSVIFMSWVRQAPGKGLECVSIIYIDDSTYYADSVKGRFTISRHNSMGTVFLEMNSLRPDDTAVYYCATESGDFGDQTGPYHYYAMDV

SEQ ID NO: 4470 - protein, 112 aa, Artificial Sequence
  Description of Artificial Sequence: Synthetic polypeptide
EVQLVETGGVVVQPGGSLRLSCAASGFTFEDYTMHWVRQVPGKGLEWVALISWDGGMSNYADSVKGRFTISRDNSKNSLYLQVSSLRSEDTALYYCAKDIRPRMPARHFMDV

SEQ ID NO: 4471 - protein, 451 aa, Artificial Sequence
  Description of Artificial Sequence: Synthetic polypeptide
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4472 - protein, 451 aa, Artificial Sequence
  Description of Artificial Sequence: Synthetic polypeptide
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4473 - protein, 451 aa, Artificial Sequence; identical to SEQ ID NO: 4471
  Description of Artificial Sequence: Synthetic polypeptide

SEQ ID NO: 4474 - protein, 451 aa, Artificial Sequence; identical to SEQ ID NO: 4471
  Description of Artificial Sequence: Synthetic polypeptide

SEQ ID NO: 4475 - protein, 450 aa, Artificial Sequence
  Description of Artificial Sequence: Synthetic polypeptide
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4476 - protein, 450 aa, Artificial Sequence
  Description of Artificial Sequence: Synthetic polypeptide
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4477 - protein, 452 aa, Artificial Sequence
  Description of Artificial Sequence: Synthetic polypeptide
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4478 - protein, 451 aa, Artificial Sequence; identical to SEQ ID NO: 4471
  Description of Artificial Sequence: Synthetic polypeptide

SEQ ID NO: 4479 - protein, 451 aa, Artificial Sequence; identical to SEQ ID NO: 4471
  Description of Artificial Sequence: Synthetic polypeptide

SEQ ID NO: 4480 - protein, 450 aa, Artificial Sequence
  Description of Artificial Sequence: Synthetic polypeptide
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4481 - protein, 451 aa, Artificial Sequence
  Description of Artificial Sequence: Synthetic polypeptide
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4482 - protein, 450 aa, Artificial Sequence
  Description of Artificial Sequence: Synthetic polypeptide
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4483 - protein, 453 aa, Artificial Sequence
  Description of Artificial Sequence: Synthetic polypeptide
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4484 - protein, 445 aa, Artificial Sequence
  Description of Artificial Sequence: Synthetic polypeptide
EVQLVQSGAEVKKPGASVKVSCKASGYTFTGYYVYWVRQAPGQGLEWMGWISAYNGNTNYAQKFQGRVTITADKSTSTAYMELSSLRSEDTAVYYCARSRSLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4485 - protein, 450 aa, Artificial Sequence
  Description of Artificial Sequence: Synthetic polypeptide
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4486 - protein, 451 aa, Artificial Sequence
  Description of Artificial Sequence: Synthetic polypeptide
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4487 - protein, 447 aa, Artificial Sequence
  Description of Artificial Sequence: Synthetic polypeptide
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4488 - protein, 451 aa, Artificial Sequence
  Description of Artificial Sequence: Synthetic polypeptide
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4489 - protein, 458 aa, Artificial Sequence
  Description of Artificial Sequence: Synthetic polypeptide
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4490 - protein, 451 aa, Artificial Sequence
  Description of Artificial Sequence: Synthetic polypeptide
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4491 - protein, 450 aa, Artificial Sequence
  Description of Artificial Sequence: Synthetic polypeptide
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4492 - protein, 450 aa, Artificial Sequence [sequence omitted]

SEQ ID NO: 4493 - protein, 450 aa, Artificial Sequence
  Description of Artificial Sequence: Synthetic polypeptide
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4494 - protein, 451 aa, Artificial Sequence
  Description of Artificial Sequence: Synthetic polypeptide
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4495 - protein, 456 aa, Artificial Sequence
  Description of Artificial Sequence: Synthetic polypeptide
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4496 - protein, 450 aa, Artificial Sequence
  Description of Artificial Sequence: Synthetic polypeptide
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4497 - protein, 118 aa, Artificial Sequence
  Description of Artificial Sequence: Synthetic polypeptide
EVQLVESGAEVKKAGSSVKVSCKSSGGTSNNFGISWVRQAPGQGLEWMGGISPIFGSTVYAQKFQGRVTISADIFSHTAYMEMNSLTSEDTAVYFCARHGNYYFYSGMDLWGQGTTVT

SEQ ID NO: 4498 - protein, 118 aa, Artificial Sequence
  Description of Artificial Sequence: Synthetic polypeptide
QVQLVQSGAEVKKPGSSVKVSCKSSGGTSNNYAISWVRQAPGQGLDWMGGVSPIFGSTAYAQKFQGRVTISADIFSNTAYMELNSLTSEDTAVYYCARHGNYYYNSGMDVWGQGTTVT

SEQ ID NO: 4499 - protein, 118 aa, Artificial Sequence
  Description of Artificial Sequence: Synthetic polypeptide
QVQLVQSGAEVKRPGSSVKVSCKSSGGTSNNYAISWVRQAPGQGLDWMGGISPIFGSTVYAQKFQGRVTISADIFSNTAYMELNSLTSEDTAVYFCARHGNYYYYSGMDLWGQGTTVT

SEQ ID NO: 4500 - protein, 118 aa, Artificial Sequence
  Description of Artificial Sequence: Synthetic polypeptide
EVQLVESGAEVKRPGSSVKVSCKSSGGTSNNYAISWVRQAPGQGLDWMGGISPIFGSTVYAQKFQGRVTISADIFSNTAYMELNSLTSEDTAVYFCARHGNYYYYSGMDLWGQGTTVT

SEQ ID NO: 4501 - protein, 121 aa, Artificial Sequence
  Description of Artificial Sequence: Synthetic polypeptide
QVQLVQSGAEVKKPGSSVKVSCKSSGGTSNNYAISWVRQAPGQGLDWMGGISPIFGSAAYAQKFQGRVTITADIFSNTVYMELNSLTSEDTAVYYCARHGNYYYYSGMDVWGQGTTVTVSS

SEQ ID NO: 4502 - protein, 121 aa, Artificial Sequence
  Description of Artificial Sequence: Synthetic polypeptide
EVQLVQSGAEVKKPGSSVRVSCKSSGGTSNNYAISWVRQAPGQGLDWMGGISPIFGSTAYAQKFQGRVTISADIFSNTAYMELNSLTSEDTAVYFCARHGNYYYYSGMDVWGQGTTVTVSS

SEQ ID NO: 4503 - protein, 121 aa, Artificial Sequence
  Description of Artificial Sequence: Synthetic polypeptide
QVQLVQSGAEVKKPGSSVKVSCKSSGGTSNNYAISWVRQAPGQGLDWMGGISPIFGSTAYAQKFQGRVTISADIFSNTAYMELNSLASEDTAVYFCARHGNYYYYSGMDVWGQGTTVTVSS

SEQ ID NO: 4504 - protein, 121 aa, Artificial Sequence
  Description of Artificial Sequence: Synthetic polypeptide
EVQLVESGAEVKKPGSSVKVSCKSSGGTSNNYAISWVRQAPGQGLDWMGGISPIFGSTAYAQKFQGRVTISADIFSNTAYMELNSLTSEDTAVYYCARHGNYYYYSGMDVWGQGTTVTVSS

SEQ ID NO: 4505 - protein, 121 aa, Artificial Sequence
  Description of Artificial Sequence: Synthetic polypeptide
EVQLVQSGAEVKKPGSSVKVSCKSSGGTSNNYAISWVRQAPGQGLDWMGGISPIFGSAAYAQKFQGRVTITADIFSNTVYMELNSLTSEDTAVYYCARHGNYYYYSGTDVWGQGTTVTVSS

SEQ ID NO: 4506 - protein, 121 aa, Artificial Sequence
  Description of Artificial Sequence: Synthetic polypeptide
EVQLVQSGAEVKKPGSSVKVSCKSSGGTSNNYAISWVRQAPGQGLDWMGGISPIFGSAVYAQKFQGRVTITADIFSNTVYMELNSLTSEDTAVYYCARHGTYYYYSGMDVWGQGTTVTVSS

SEQ ID NO: 4507 - protein, 121 aa, Artificial Sequence; identical to SEQ ID NO: 4504
  Description of Artificial Sequence: Synthetic polypeptide

SEQ ID NO: 4508 - protein, 121 aa, Artificial Sequence
  Description of Artificial Sequence: Synthetic polypeptide
QMQLVQSGAEVKKPGSSVKVSCKSSGGTSNNYAISWVRQAPGQGLDWMGGISPIFGSTAYAQKFQGRVTISADIFSNTAYMELNSLTSEDTAVYFCARHGNYYYYSGMDVWGQGTTVTVSS

SEQ ID NO: 4509 - protein, 121 aa, Artificial Sequence
  Description of Artificial Sequence: Synthetic polypeptide
QVQLVQSGAEVERPGSSVKVSCKSSGGTSNNYAISWVRQAPGQGLDWMGGISPIFGSTAYAQKFQGRVTISADIFSNTAYMELNSLTSEDTAVYYCARHGNYYYNSGMDVWGQGTTVTVSS

SEQ ID NO: 4510 - protein, 121 aa, Artificial Sequence
  Description of Artificial Sequence: Synthetic polypeptide
QVQLVQSGAEVKKPGSSVKVSCKSSGGTSNNYAISWVRQAPGQGLDWMGGISPIFGSTAYAQKFQGRVTISADIFSNTAYMELNSLTSEDTAVYYCARHGNYYYYSGMDVWGQGTTVTVSS

SEQ ID NO: 4511 - protein, 121 aa, Artificial Sequence
  Description of Artificial Sequence: Synthetic polypeptide
QMQLVQSGAEVKKAGSSVKVSCKSSGGTSNNYAISWVRQAPGQGLEWMGGISPIFGSTVYAQKFQGRVTISADIFSHTAYMELNSLTSEDTAAYFCARHGNYYYYSGMDLWGQGTTVTVSS

SEQ ID NO: 4512 - protein, 121 aa, Artificial Sequence
  Description of Artificial Sequence: Synthetic polypeptide
QVQLVQSGAEVKKPGSSVKVSCKSSGGTSNNYAISWVRQAPGQGLDWMGGISPIFGSTAYAQKFQGRVTISADIFSNTAYMELNSLTSEDTAVYFCARHGNYYYYSGMDVWGQGTTVTVSS

SEQ ID NO: 4513 - protein, 124 aa, Artificial Sequence
  Description of Artificial Sequence: Synthetic polypeptide
EVQLVETGGGLVQPGRSLRLSCAASGFSFDEYTMHWVRQAPGKGLEWVAGINWKGNFMGYADSVQGRFTISRDNGKNSLYLQMNSLRAEDTALYYCAKDRLESSAMDILEGGTFDIWGQGTMVT

SEQ ID NO: 4514 - protein, 125 aa, Artificial Sequence
  Description of Artificial Sequence: Synthetic polypeptide
EVQLVQSGAEVKKPGASVRVSCRASGYIFTESGITWVRQAPGQGLEWMGWISGYSGDTKYAQKLQGRVTMTKDTSTTTAYMELRSLRYDDTAVYYCARDVQYSGSYLGAYYFDYWSPGTLVTVSS

SEQ ID NO: 4515 - protein, 126 aa, Artificial Sequence
  Description of Artificial Sequence: Synthetic polypeptide
QVQLVQSGAEVKKPGASVRVSCRASGYIFTESGITWVRQAPGQGLEWMGWISGYSGDTKYAQKLQGRVTMTKDTSTTTAYMELRSLRYDDTAVYYCARDVQYSGSYLGAYYFDYWSPGTLVTVSSN

SEQ ID NO: 4516 - protein, 129 aa, Artificial Sequence
  Description of Artificial Sequence: Synthetic polypeptide
EVQLVQSGAEVKKPGASVELSCKASGDTFTNYHIHWVRQAPGQGLEWMGIINPSGGDTDYSQKFQGRVTLTRDRSTNTFYMKLASLRSEDTAVYYCATDESPGLLTGLRDYWYYYGMDVWGQGTTVTVS

SEQ ID NO: 4517 - protein, 122 aa, Artificial Sequence
  Description of Artificial Sequence: Synthetic polypeptide
EVQLVESGGGLVQPGGSLRLSCAASGFTFSSYAMSWVRQAPGKGLEWVSRLSDESTTYYADSVKGRFTISRDNSKNTLYLQMNSLKADDTAIYYCAEDLGTVMDSYYYGMNVWGPGTTVTVS

SEQ ID NO: 4518 - protein, 127 aa, Artificial Sequence
  Description of Artificial Sequence: Synthetic polypeptide
EVQLVETGGGLVQPGRSLRLSCAASGFTFDDYAMHWVRQAPGKGLEWVSGINWVSTTMGYADSVKGRFTISRDNAKNSLYLQMNSLRAEDTALYYCAKDRLESAAIDILEGGTFDIRGQGTMVTVSS

SEQ ID NO: 4519 - protein, 126 aa, Artificial Sequence
  Description of Artificial Sequence: Synthetic polypeptide
QVQLQESGPGLVKPSGTLSLTCNVSGGSINSSPYKWAWIRQSPGKGLEWIGTFYYDGSTDYNPSLQSRLTISGDMSSNHFSLRLRSVTAADTAVYYCAAYCSSISCHAYYDYMNVWGKGTTVTVSS

SEQ ID NO: 4520 - protein, 121 aa, Artificial Sequence
  Description of Artificial Sequence: Synthetic polypeptide
QVQLVQSGAEVKKPGSSVKVSCKTSGYAFNGYGISWVRQAPGQGLEWVAWINTYKVNTHYAQNLRGRVTVSIDTSTTTAYMELRSLRSDDTAVYYCARDWGGPFGNAFDFWGQGTMVTVSS

SEQ ID NO: 4521 - protein, 125 aa, Artificial Sequence
  Description of Artificial Sequence: Synthetic polypeptide
EVQLVQSGAEVKKPGASVTVSCKASGYAFTSYYLHWVRQAPGQGLEWMGIMNLHGGSTTYAQKFQGRVTMTRDTSTRTVYMELSGLRSEDSAVYYCARESPDSSGYPGYYGMDVWGQGTTVTVSS

SEQ ID NO: 4522 - protein, 125 aa, Artificial Sequence
  Description of Artificial Sequence: Synthetic polypeptide
EVQLVESGAEVKKPGASVKVSCKASGYAFTSYYLHWVRQAPGQGLEWMGIMNPHGGSTTYAQKFQGRVTMTRDTSTSTVYMELSSLRSEDTAVYYCARESPDSSGYPGYYGMDVWGQGTTVTVSS

SEQ ID NO: 4523 - protein, 121 aa, Artificial Sequence
  Description of Artificial Sequence: Synthetic polypeptide
EVQLVQSGAEVKKPGESVKISCKTSGYAFTGYGISWVRQAPGQGLEWMGWINTYKFNTNYAQNLQGRVTMTIDTSTSAAYMELRSLRYEDTAVYFCARDWAGPFGNAFDVWGQGTMVTVSS

SEQ ID NO: 4524 - protein, 124 aa, Artificial Sequence
  Description of Artificial Sequence: Synthetic polypeptide
EVQLVESGGGLVQPGRSLRLSCAASGFTFDEYIMHWVRQAPGKGPEWVAGINWKGNFMGYADSVQGRFTISRDNAKNSLYLQMNSLRADDTALYYCAKDRLESSAMDILEGGTFDIWGQGTMVT

SEQ ID NO: 4525 - protein, 127 aa, Artificial Sequence
  Description of Artificial Sequence: Synthetic polypeptide
EVQLVESGGGLVQPGRSLRLSCAASGFSFDEYIMHWVRQAPGKGLEWVAGINWKGNFMGYADSVQGRFTISRDNGKNSLYLQMNSLRAEDTALYYCAKDRLESSAMDILEGGTFDIWGQGTMVTVSS

SEQ ID NO: 4526 - protein, 127 aa, Artificial Sequence
  Description of Artificial Sequence: Synthetic polypeptide
EVQLVETGGGLVQPGRSLRLSCAASGFTFDEYIMHWVRQAPGKGPEWVAGINWKGNFMGYADSVQGRFTISRDNAKNSLYLQMNSLRADDTALYYCAKDRLESSAMDILEGGTFDIWGQGTMVTVSS

SEQ ID NO: 4527 - protein, 127 aa, Artificial Sequence
  Description of Artificial Sequence: Synthetic polypeptide
EVQLVESGGGLVQPGRSLRLSCAASGFTFDEYIMHWVRQAPGKGPEWVAGINWKGNFMGYADSVQGRFTISRDNAKNSLYLQMNSLRADDTALYYCAKDRLESSAMDILEGGTFDIWGQGTMVTVSS

SEQ ID NO: 4528 - protein, 108 aa, Artificial Sequence
  Description of Artificial Sequence: Synthetic polypeptide
QESGAELVRPGASVKLSCKDSGYTFTTYWMNWVKQRPEQGLEWIGRIDPYDSETHYNQKFKDKAILTVDKSSNTAYMQLSSLTSEDSAVYYCVRGGSTVAYFGVWGQG

SEQ ID NO: 4529 - protein, 119 aa, Artificial Sequence; identical to SEQ ID NO: 4344
  Description of Artificial Sequence: Synthetic polypeptide

SEQ ID NO: 4530 - protein, 117 aa, Artificial Sequence
  Description of Artificial Sequence: Synthetic polypeptide
  MOD_RES (2)..(2): Any amino acid
RXGGGLVQPGGSLRLSCAASRFTFSRYAMNWVRQAPGKGLEWVSSITGSGGRTFYADSVKGRFTISRDNSKNTLYLQMNSLRAEDTALYYCAKPPTVTTGDPFDIWGQGTMVTVSSP

SEQ ID NO: 4531 - protein, 134 aa, Artificial Sequence
  Description of Artificial Sequence: Synthetic polypeptide
EVQLVQSGGGLIQPGGSLRLSCAASGFTVSNNYISWVRQAPGKGLEWVSVIYSGGSRYYPESVKGRFTISRDNSKNTLYLQMNSLRYEDTAVYYCARVSCNSTSCHPVYVRTTVWTSGAKGPQSPSPQPPPRAH

SEQ ID NO: 4532 - protein, 95 aa, Artificial Sequence
  Description of Artificial Sequence: Synthetic polypeptide
SSAFSSLAMSWVRQAPGQGLEWVSAIIGSGGSTYYADSVKGDFTISRDNSKNTPLQMNSLRAEDTAPYYCLKTPTCTTGVLLDYCGQGTLVSVSS

SEQ ID NO: 4533 - protein, 124 aa, Artificial Sequence
  Description of Artificial Sequence: Synthetic polypeptide
EVQLVESGGGLVQPGGSLRLSCAASGFSFSSYWMTWVRQAPGKGLEWVANIKQYGSEKYYVDSVKGRFTISRDNAKNSLYLQMNSLRDDDTAVYYCARMGSYLDTYYYHYGMDVWGQGTTVTVS

SEQ ID NO: 4534 - protein, 129 aa, Artificial Sequence; identical to SEQ ID NO: 4378
  Description of Artificial Sequence: Synthetic polypeptide
  MOD_RES (2)..(2): Any amino acid

SEQ ID NO: 4535 - protein, 127 aa, Artificial Sequence; identical to SEQ ID NO: 4456
  Description of Artificial Sequence: Synthetic polypeptide

SEQ ID NO: 4536 - protein, 122 aa, Artificial Sequence
  Description of Artificial Sequence: Synthetic polypeptide
EVQLVQSGGGLVQPGGSLRLACVVSGFTVTSNYITWVRQAPGKGLEWVSVIYSHGRAYYSASVNGRFTISRHTSKNTVYLEMNSLRPEDTAVYYCAGGGLVGGYDEYFFDYWGQGTLATVSS

SEQ ID NO: 4537 - protein, 118 aa, Artificial Sequence
  Description of Artificial Sequence: Synthetic polypeptide
QVQLVQSGAEVKKPGSSVKVSCKASGGSFSNYAFSWVRQAPGQGLEWMGGTIPLLGTTNYAQKFQGRVTISADQFTSTAYMELGSLRSEDTAVYYCTRRKMTTAFDSWGQGTLVTVSS

SEQ ID NO: 4538 - protein, 123 aa, Artificial Sequence
  Description of Artificial Sequence: Synthetic polypeptide
QVQLAQSGAEVKRPGSSVKVSCTASGGIFRKNAISWVRQAPGQGLEWMGGIIAVFNTANYAQKFQGRVKITADESGNTAYMELSSLRSDDTAVYYCASHPKYFYGSGSYPDFWGQGTLVTVSS

SEQ ID NO: 4539 - protein, 129 aa, Artificial Sequence
  Description of Artificial Sequence: Synthetic polypeptide
EVLMVESGGGLVQPGGSVRLSCVASGFSFSSHWMTWVRQAPGKGLEWVANIEDDGGDKYYVDSVKGRFIISRDNAKNSVYLQMNSLRAEDTAVYFCARGSGSSDRSDYDPHYYYYLDVWGKGATVTVSS

SEQ ID NO: 4540 - protein, 124 aa, Artificial Sequence
  Description of Artificial Sequence: Synthetic polypeptide
QVQLQESGPGLVKPSETLSLNCAVSGGSISNYYWSWIRQPPGKGLEWIGYISYNGRPKYNPSLTSRVTISVDTSKDQFSLELRSVTAADTALYYCARETRFGELLSPYDAFEIWGQGTMVTVSS

SEQ ID NO: 4541 - protein, 133 aa, Artificial Sequence
  Description of Artificial Sequence: Synthetic polypeptide
QVQLVQSGSEVKKPGASVKVSCKASGYTFTNYDINWIRQAPGQGLEWMGWINPNSGTTGSAQRFQGRVTITVDTSITTVYMELSSLRSDDTAIYYCARGRELLRLQHFLTDSQSERRDCFDPWGQGTLVTVSS

SEQ ID NO: 4542 - protein, 120 aa, Artificial Sequence
  Description of Artificial Sequence: Synthetic polypeptide
QITLRESGPTLVKPTQTLTLTCTFSGFSLSTNGVNVGWIRQPPGKALEWLALIYWDDDKRYSPSLKRRLTITKDTSKNQVVLTLTNMDPVDTATYYCAHRPDFYGDFEYWGPGTLVTVSS

SEQ ID NO: 4543 - protein, 121 aa, Artificial Sequence
  Description of Artificial Sequence: Synthetic polypeptide
QVQLVQSGAEVRKPGSSVKVSCKASGGPFMSYAIGWVRQAPGQGLEWMGGINPVFGRPHYAQKFQGRVTIATDDSTKTSYMELSSLTSEDTGMYYCASRYSRSSPGTFESWGQGTLVTVSS

SEQ ID NO: 4544 - protein, 129 aa, Artificial Sequence
  Description of Artificial Sequence: Synthetic polypeptide
EVQLVESGGDLVQPGRSLKLSCTGSGFTFGDYGVTWVRQAPGKGLEWVGFIRTRPWGGTADTAASVKGRFTISRDDSKSLAYLQMNSLKTEDTAVYYCCRDAPPNVEVASMTNWYFDLWGRGTLVTVSS

SEQ ID NO: 4545 - protein, 124 aa, Artificial Sequence
  Description of Artificial Sequence: Synthetic polypeptide
QVQLQESGPGLVKPSETLSLTCTVSGGSVSSETYYWSWIRQPPGKGLEWIGYIYYIGNTDYRPSLKSRVTISLDTSKNQFSLKLSSVTAADTAVYYCARGAYYDSSGYPAFYIWGQGTMVTVSS

SEQ ID NO: 4546 - protein, 118 aa, Artificial Sequence
  Description of Artificial Sequence: Synthetic polypeptide
QVQLVQSGADVKKPGSSVTVSCKASGGSFSNYGINWVRQAPGQGLEWMGGIIPLINAPNYAPKFQGRVTITADMFSNIVSLQLTSLRTDDTAVYYCARRKMTTAIDYWGQGTLVTVSS

SEQ ID NO: 4547 - protein, 118 aa, Artificial Sequence
  Description of Artificial Sequence: Synthetic polypeptide
QVQLVQSGAEVKKPGSSVKVSCRESGGTFNGYTITWVRQAPGQGLEWMGGIIPMMGTVNYAQKLQGRVTITTDYFTKTAYMDLNNLRSEDTAMYYCVKIRYTGQQLLWGQGTLVTVSS

SEQ ID NO: 4548 - protein, 120 aa, Artificial Sequence
  Description of Artificial Sequence: Synthetic polypeptide
QVQLVQSGSEVKKPGTSVKVSCTASGSVFTNYGISWVRQAPGQGLEWMGGIIPLFGAAKYAQKFQGRVTITADESTKTVYMELSRLTSKDTAIYFCAKAPRVYEYYFDQWGQGTPVTVSS

SEQ ID NO: 4549 - protein, 130 aa, Artificial Sequence
  Description of Artificial Sequence: Synthetic polypeptide
QVQLQQWGAGLLKPSETLSLTCAVYGGSFSVSGYYWSWIRQPPGRGLEWIGEISHGGSTNYNPSLKSRVTISVDTTKNQFSLRLSSVTAADTAVYYCARGTDPDTEVYCRVGNCAAFDYWGQGSLVTVSS

SEQ ID NO: 4550 - protein, 128 aa, Artificial Sequence
  Description of Artificial Sequence: Synthetic polypeptide
QVQLQQWGSGLLKPSETLSLTCAVYGGSFRDDYWTWIRQPPGKGLEWIGEINHSGRTNYNPSLKSRVTISVDTSLKQFSLKVISVTAADTAVYYCARGTSHVSRYFDWLPPTNWFDPWGQGTQVTVSS

SEQ ID NO: 4551 - protein, 132 aa, Artificial Sequence
  Description of Artificial Sequence: Synthetic polypeptide
QITLKESGPTLVKPTQTLTLTCVFSGFSLSITGVRVGWIRQPPGKALEWLALISWDDEKHYSPSLQSRLTITKDTSKNQVVLTMTNLDPVDTATYYCARSTDRGHVLRYFGWMLPGDAFDVWGQGTMVTVSS

SEQ ID NO: 4552 - protein, 125 aa, Artificial Sequence
  Description of Artificial Sequence: Synthetic polypeptide
QVQLVESGGGVVQPGRSLRLSCAASEITFITYAMHWVRQAPGKGLEWVALISDDGSNKFYADSVKGRFTISRDNSKNTLYLQMNSLRAEDTAAYYCAREGVYFDSGTYRGYFDYWGQETLVTVSS

SEQ ID NO: 4553 - protein, 121 aa, Artificial Sequence
  Description of Artificial Sequence: Synthetic polypeptide
QVQLVQSGGGVVQPGRSLRLSCAASGFTFSSYAMHWVRQAPGKGLEWVAIISYDGNDQYYTDSVKGRFTISRDSSKVYLQMHRLRPEDTAVYYCAKEFETSGYFHGSFDYWGQGILVTVSS

SEQ ID NO: 4554 - protein, 126 aa, Artificial Sequence
  Description of Artificial Sequence: Synthetic polypeptide
QVQLQESGPGLVKPSETLSLTCTVSGGSINSYYWNWIRQPPGKGLEWIGYIYHSGSTNYNPSLKSRVTISVDTSKNQFSLQLSSVTAADTAVYYCARLRTDYGDPDSVYYYGMDVWGQGTTVTVSS

SEQ ID NO: 4555 - protein, 125 aa, Artificial Sequence
  Description of Artificial Sequence: Synthetic polypeptide
QVQLQESGPGLVKPSQTLSLTCTVSGGSISSGNYYWNWVRQHPGKGLEWIGYIYYRGSTFYNPSLKSRVTISIDTSKNQFSLRLSSVTAADTAVYYCAKDTRSSLDNYQYGMDVWGQGTTVTVSS

SEQ ID NO: 4556 - protein, 126 aa, Artificial Sequence
  Description of Artificial Sequence: Synthetic polypeptide
QVHLVQSGAEVRKPGDSVKVSCKTSGYTFSTYPVAWVRQVPGQGLEWMGWISTYNGNTNFAQNFQGRVTLTTDTTTNTAYMEVRSLKFDDTAVYYCARVEGSYRDFWNNQNRFDPWGQGTLVTVSS

SEQ ID NO: 4557 - protein, 123 aa, Artificial Sequence
  Description of Artificial Sequence: Synthetic polypeptide
QVQLQESGPGLVKPSETLSLTCTVSRGSIGHYFWSWIRQPPGKGLEWIGYISYSGSTKYNPSLRSRVTISVDTSKNQFSLNLNSVTATDTALYYCAREDYDILTGAGPGMEVWGQGTTVTVSS

SEQ ID NO: 4558 - protein, 128 aa, Artificial Sequence
  Description of Artificial Sequence: Synthetic polypeptide
QVQLQQWGAGLLKPSETLSLSCAVFGGSFSDYYWTWIRQPPGKGLEWIGEIKHSGRTNYNPSLESRVTISVDTSKNQFSLKLSSVTAADTAIYYCARGTDPDTEGYCRSGSCSAFDFWGQGTLVTVSS

SEQ ID NO: 4559 - protein, 128 aa, Artificial Sequence
  Description of Artificial Sequence: Synthetic polypeptide
QVQLQQWGAGLLKPSETLSLTCGVYGGSLSDYYWSWIRQPPGKGLEWIGEINHSGGTNYNPSLKRRVTISVDTSKKQFSLKMNSVTAADTAVYYCARGTDPDTEVYCRAGNCAAFDFWGQGTLVTVSS

SEQ ID NO: 4560 - protein, 128 aa, Artificial Sequence
  Description of Artificial Sequence: Synthetic polypeptide
QVQLQESGPGLVKPSQTLSLTCTVSGDSISSVDHYWSWIRQHPVKGLEWIGFMYYSASTYYNPSLKSRVTISTDTSKNQFSLRLSSVTAADTAVYYCARGTCAGDCSLHYYYYGLDVWGQGRTVTVSS

SEQ ID NO: 4561 - protein, 132 aa, Artificial Sequence
  Description of Artificial Sequence: Synthetic polypeptide
QVQLQESGPGLVKPSETLSLTCTVSSGPMSDYYWSWIRQPPGKGLEWIGHVSVSHGGRTKSNPSVMSRVTISVETSKNQFSLKLTSVTAADTAVYYCARLNYYDRSGYHSPDGPSNNWFDPWGQGTLVTVSS

SEQ ID NO: 4562 - protein, 122 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGDTNYAQKFQGRVTMTRDTSITTAYMELSSLRSDDTAVYYCARDSPYSSSWSFFDYWGQGPLVTVSS

SEQ ID NO: 4563 - protein, 123 aa, Artificial Sequence
  Description of Artificial Sequence: Synthetic polypeptide
QVQLQESGPGLVKPSETLSLTCTVSGASINSHYWSWIRQPPGKGLEWIGYVYYSGSTTYNPSLKSRVTLSVDTSKNQFSLNLSSVTAADTAFYYCARHPYDVLTGSGDWFDPWGQGTLVTVSS

SEQ ID NO: 4564 - protein, 128 aa, Artificial Sequence
  Description of Artificial Sequence: Synthetic polypeptide
EVQLVQSGSEVKKPGESLKISCKGSGYSFSNYWIGWVRHMPGKGLEWMGHYPGDSDTRYSPSFQGQVTMSADKSSSTVYLQWSSLKASDTAIYYCARRGGHSFGYGSGGDTHSEFDSWGQGTLVTVSS

SEQ ID NO: 4565 - protein, 121 aa, Artificial Sequence
  Description of Artificial Sequence: Synthetic polypeptide
QVQVVQSGAEVKKPGSSVRVSCQASGGTFMNYAIIWVRRAPGQGLEWMGGIIPVFPTPNYAQMFQGRVTISTDESRSTSFLELTNLRYEDTAVYYCARRIYHGGNSGFDFWGQGTLVTVSS

SEQ ID NO: 4566 - protein, 119 aa, Artificial Sequence
  Description of Artificial Sequence: Synthetic polypeptide
QVQVVQSGTEVKKPGSSVKVSCQTSGGRFMSYAITWVRQAPGQGLEWMGGIVPVFGTANYAQKFQGRVTITTDDSTRTAYMELSSLRSEDTAVYYCGFRYGSGYGFDSWGQGTLVTVSS

SEQ ID NO: 4567 - protein, 120 aa, Artificial Sequence
  Description of Artificial Sequence: Synthetic polypeptide
QVQLVQSGADLKKPGASVKVSCKASGYTFTDYYIHWVRQAPGQGLEWMGWINPESGDTKYAQKFQGRVTMTRDTSITTAYMELGRLRSDDTAVYYCARDVSTTWSWFAPWGQGTLVTVSS

SEQ ID NO: 4568 - protein, 123 aa, Artificial Sequence
  Description of Artificial Sequence: Synthetic polypeptide
QVQLVQSGAEVKRPGSSVKVSCTASGGIFRKNAISWVRQAPGQGLEWMGGIIAVFNTANYAQKFQNRVKITADESGNTAYMELSSLTSDDTAVYYCASHPKYFYGSGSYPDFWGQGTLVTVSS

SEQ ID NO: 4569 - protein, 127 aa, Artificial Sequence
  Description of Artificial Sequence: Synthetic polypeptide
QVQLVQSGAEVKKPGASVKVSCKASGYTFIGYDMHWVRQAPGQGLEWMGWINAKRGGTNYAQKFQGRVTMTRDTSISTAYMELNSLRSDDTAVYYCARGVGSRTTIFGVLNPEFDYWGQGTLVTVSS

SEQ ID NO: 4570 - protein, 118 aa, Artificial Sequence
  Description of Artificial Sequence: Synthetic polypeptide
QVQLVQSGAEVKKPGASVKVSCKASGHTFTGYYIHWVRQAPGQGLEWMGWINPDSGATSSAQNFQGRVTMTGDTSSSTAYMELSRLSFDDTAVYYCARVLFTSPFDFWGEGTLVTVSS

SEQ ID NO: 4571 - protein, 117 aa, Artificial Sequence
  Description of Artificial Sequence: Synthetic polypeptide
QEQLVQSGAEVKKPGASVKVSCKASRKSFIGYYVHWVRQAPGQGLEWMGWISPDSDATKYAQKFQGSVIMTRDTSVSTVYMELSRLTSDDTALYYCLLFRGGNSLSWGQGTLVTVSS

SEQ ID NO: 4572 - protein, 122 aa, Artificial Sequence
  Description of Artificial Sequence: Synthetic polypeptide
EVQLVESGGGLVQPGGSLRLSCAASGFIFRNYWMSWVRQAPGKGLEWVANIKQDGREKYYVDSLRGRVNISRDNAENSLYLHMNSLRVEDTAVYFCARARMVVVTGDGFDVWGHGTMVTVSS

SEQ ID NO: 4573 - protein, 124 aa, Artificial Sequence
  Description of Artificial Sequence: Synthetic polypeptide
QVQLQESGPGLVKPSETLSLTCAVSGVSISNIDFYWGWIRQPPGKGLEWIGNIYYTGITFYNPSLSSRVAISIDTSKNQFSLTLTSVTAADTAMYYCARHYGDSEAINDAFDIWGQGTMLTVSS

SEQ ID NO: 4574 - protein, 115 aa, Artificial Sequence
  Description of Artificial Sequence: Synthetic polypeptide
QVQLVQSGAEVKKPGSSVRVSCKTSGGTFSSYAVTWVRQAPGQGLEWMGGIIGMFGTTNYAQKFQGRLTITADEMTSTAYMELSSLRSEDTAVYYCARGSYYYETTLDYWGRGTL

SEQ ID NO: 4575 - protein, 115 aa, Artificial Sequence
  Description of Artificial Sequence: Synthetic polypeptide
QVQLVQSGAEVKKPGSSVKVSCKTSGGTFSSYAVTWVRQAPGQGLEWMGGIIGMFGTTNYAQKFQGRVTITADELTSTAYMELSSLRSEDTAVYYCARGSYYYESSLDYWGRGTL

SEQ ID NO: 4576 - protein, 115 aa, Artificial Sequence
  Description of Artificial Sequence: Synthetic polypeptide
EVQLVQSGAEVKKPGSSVKVSCKTSGGTFSSYAVTWVRQAPGQGLEWMGAIIGMFGTTNYAQKFQGRVTITADELTSTAYMELSSLRSDDTAVYYCARGSYYYESSLDYWGKGTL

SEQ ID NO: 4577 - protein, 118 aa, Artificial Sequence
  Description of Artificial Sequence: Synthetic polypeptide
QVQLQESGPGLVKPSETLSLTCTVSGYSFDSGYYWGWLRQPPGKGLEWIGSIYHSRNTYYNPSLKSRVTISVDTSKNQFSLQLSSVTAADTAVYYCARGTWYSSNLRYWFDPWGKGTL

SEQ ID NO: 4578 - protein, 120 aa, Artificial Sequence; identical to SEQ ID NO: 4348
  Description of Artificial Sequence: Synthetic polypeptide

SEQ ID NO: 4579 - protein, 121 aa, Artificial Sequence; identical to SEQ ID NO: 4349
  Description of Artificial Sequence: Synthetic polypeptide

SEQ ID NO: 4580 - protein, 138 aa, Artificial Sequence
  Description of Artificial Sequence: Synthetic polypeptide
QVQLQESGGGLVQPGESLRLSCVGSGSSFGESTLSYYAVSWVRQAPGKGLEWLSIINAGGGDIDYADSVEGRFTISRDNSKETLYLQMTNLRVEDTGVYYCAKHMSMQQVVSAGWERADLVGDAFDVWGQGTMVTVSS

SEQ ID NO: 4581 - protein, 127 aa, Artificial Sequence
  Description of Artificial Sequence: Synthetic polypeptide
QVQLQQSGPRLVKPSQTLSLTCAISGDSVSGDSGTWNWIRQSPSRGLEWLGRTYYRSKWYNDYAESVKSRIVIKADTSKNEFSLQLNSVTPEDTAIYYCARAGVKIFGLIVGALDNWGRGTLVTVSS

SEQ ID NO: 4582 - protein, 113 aa, Artificial Sequence
  Description of Artificial Sequence: Synthetic polypeptide
EVQLVESGGGLIQPGGSLRLSCAASGFTVSSNYVSWVRQAPGKGLEWLSLIYTGGTTYYADSVKGRFTISRDNSKNTVFLQMNSLRAEDAAMYYCARVSALRFLQWPNYAMDV

SEQ ID NO: 4583 - protein, 114 aa, Artificial Sequence
  Description of Artificial Sequence: Synthetic polypeptide
EVQLVETGGDLVQPGGSLRLSCSASEFSFSSYWMSWVRQAPGKGLEWVANMKQDGSEKYYVDSVKGRFTISRDNAKNSLYLQMNSLRGEDTAVYYCARGSCDDSWTGCHDAFDI

SEQ ID NO: 4584 - protein, 114 aa, Artificial Sequence
  Description of Artificial Sequence: Synthetic polypeptide
QVQLQESGGDLVQPGGSLRLSCSASEFSFSSYWMSWVRQAPGKGLEWVANMKQDGSEKYYVDSVKGRFTISRDNAKNSLYLQMNSLRGEDTAVYYCARGSCDDSWTGCHDAFDI

SEQ ID NO: 4585 - protein, 114 aa, Artificial Sequence
  Description of Artificial Sequence: Synthetic polypeptide
EVQLVESGGDLVQPGGSLRLSCSASEFSFSSYWMSWVRQAPGKGLEWVANMKQDGSEKYYVDSVKGRFTISRDNAKNSLYLQMNSLRGEDTAVYYCARGSCDDSWTGCHDAFDI

SEQ ID NO: 4586 - protein, 114 aa, Artificial Sequence; identical to SEQ ID NO: 4583
  Description of Artificial Sequence: Synthetic polypeptide

SEQ ID NO: 4587 - protein, 114 aa, Artificial Sequence; identical to SEQ ID NO: 4583
  Description of Artificial Sequence: Synthetic polypeptide

SEQ ID NO: 4588 - protein, 145 aa, Artificial Sequence
  Description of Artificial Sequence: Synthetic polypeptide
MAEVQLVESGPALVKPTQTLTLTCSFSGFSLSTSGMSVSWIRQPPGKALEWLALIDWDDDTYYITYSSSLKTRLTISKDTSKSQVVLTMTNMDPVDTATYYCARTLRVSGDYVRDFDLWGRGTLVTVSSAGTKGPVENDSITSEF

SEQ ID NO: 4589 - protein, 123 aa, Artificial Sequence
  Description of Artificial Sequence: Synthetic polypeptide
EVQLQQSGPELVKPGASVKMSCKASGYTFTSFIMYWVKQKPGQGLEWLGYIDPYNDGTKYNEKFEGKATLTSDKSSSTAYMELSSLTSEDSAVYYCAKRGNYGNGFAYWGQGTLVTVSAAKTS

SEQ ID NO: 4590 - protein, 126 aa, Artificial Sequence
  Description of Artificial Sequence: Synthetic polypeptide
QVQLQQSGAELVRPGTSVKISCKASGYAFSNYWLGWVKQRPGHGLEWIGDIYPGSGNNHYNEKFKGKATLTADKSSRTVYMQLSSLTSEDSSVYFCTRGPIFTTAWFAYWGQGTLVTVSAAQKQTW

SEQ ID NO: 4591 - protein, 120 aa, Artificial Sequence
  Description of Artificial Sequence: Synthetic polypeptide
EVQLVESGGGLVQPGGSLRISCAASGFTVSSNYMSWVRQAPGKGLEWVSVIYSGGSTYYADSVKGRFSFSRDNSKNTVFLQMNSLRAEDTAVYYCARCLSRMRGYGLDVWGQGTTVTVSS

SEQ ID NO: 4592 - protein, 120 aa, Artificial Sequence
  Description of Artificial Sequence: Synthetic polypeptide
QVQLQESGPGLVKPSETLSLTCTVSGSSISNYYWSWIRQSPGKGLEWIGFIYYGGNTKYNPSLKSRVTISQDTSKSQVSLTMSSVTAAESAVYFCARASCSGGYCILDYWGQGTLVTVSS

SEQ ID NO: 4593 - protein, 123 aa, Artificial Sequence; identical to SEQ ID NO: 4372
  Description of Artificial Sequence: Synthetic polypeptide

SEQ ID NO: 4594 - protein, 118 aa, Artificial Sequence; identical to SEQ ID NO: 4373
  Description of Artificial Sequence: Synthetic polypeptide

SEQ ID NO: 4595 - protein, 121 aa, Artificial Sequence; identical to SEQ ID NO: 4358
  Description of Artificial Sequence: Synthetic polypeptide

SEQ ID NO: 4596 - protein, 120 aa, Artificial Sequence
  Description of Artificial Sequence: Synthetic polypeptide
QVQLQESGPGLVKPSETLSLTCTVSGGSISAYHWSWIRQPPGKGLEWIGHIFDSGSTYYNPSLKSRVTISLDASKNQLSLRLTSVTASDTAIYYCARPLGSRYYYGMDVWGQGTTVTVSS

SEQ ID NO: 4597 - protein, 119 aa, Artificial Sequence; identical to SEQ ID NO: 4367
  Description of Artificial Sequence: Synthetic polypeptide

SEQ ID NO: 4598 - protein, 121 aa, Artificial Sequence; identical to SEQ ID NO: 4366
  Description of Artificial Sequence: Synthetic polypeptide

SEQ ID NO: 4599 - protein, 119 aa, Artificial Sequence; identical to SEQ ID NO: 4365
  Description of Artificial Sequence: Synthetic polypeptide

SEQ ID NO: 4600 - protein, 119 aa, Artificial Sequence; identical to SEQ ID NO: 4364
  Description of Artificial Sequence: Synthetic polypeptide

SEQ ID NO: 4601 - protein, 120 aa, Artificial Sequence; identical to SEQ ID NO: 4363
  Description of Artificial Sequence: Synthetic polypeptide

SEQ ID NO: 4602 - protein, 118 aa, Artificial Sequence; identical to SEQ ID NO: 4362
  Description of Artificial Sequence: Synthetic polypeptide

SEQ ID NO: 4603 - protein, 118 aa, Artificial Sequence; identical to SEQ ID NO: 4361
  Description of Artificial Sequence: Synthetic polypeptide

SEQ ID NO: 4604 - protein, 120 aa, Artificial Sequence; identical to SEQ ID NO: 4360
  Description of Artificial Sequence: Synthetic polypeptide

SEQ ID NO: 4605 - protein, 121 aa, Artificial Sequence; identical to SEQ ID NO: 4359
  Description of Artificial Sequence: Synthetic polypeptide

SEQ ID NO: 4606 - protein, 121 aa, Artificial Sequence; identical to SEQ ID NO: 4358
  Description of Artificial Sequence: Synthetic polypeptide

SEQ ID NO: 4607 - protein, 122 aa, Artificial Sequence; identical to SEQ ID NO: 4357
  Description of Artificial Sequence: Synthetic polypeptide

SEQ ID NO: 4608 - protein, 141 aa, Artificial Sequence
  Description of Artificial Sequence: Synthetic polypeptide
MKHLWFFLLLVAAPRWVLSQVQLQESGPGLVKPSETLSLTCTVSGGSISHDYWSWIRQPPGKGLEWIGYIYYSGSTNYNPSLKSRVTISVDTSRNQFSLKLSSVTAADTAVYYCASLVGASEVLGYYFVYWGQGTLVTVSS

SEQ ID NO: 4609 - protein, 121 aa, Artificial Sequence
  Description of Artificial Sequence: Synthetic polypeptide
QLQLQESGLGLVKPSETLSLTCTVSGDSVSSGSYYWSWLRQPPGKGLEWIGNMHGSGHTNYNPSLKSRVTITPDTSKNHFSLRLSSVTAADTAVYYCARALLTTVTTFEYWGQGTLVTVSS

SEQ ID NO: 4610 - protein, 120 aa, Artificial Sequence
  Description of Artificial Sequence: Synthetic polypeptide
QVQLVQSGAEVKKSGSSVKVSCKASGGTFSNYAISWVRQAPGQGLEWMGGIIPVFGTPNYAQKFQGKIRIIADESTSTMYMELSSLRSEDTAVYYCASGRDFYYYGMDVWGQGTTVTVSS

SEQ ID NO: 4611 - protein, 127 aa, Artificial Sequence
  Description of Artificial Sequence: Synthetic polypeptide
QVQLVQSGAEVKKPGASVKVSCKASGYTFTNYAIHWVRQAPGQRLEWMGWINAGKGNTKYSQKFQDRVTITRDTSASAAYMELNSLISEDTTVYYCARGNPNHDFWSSYYPGSFDCWGQGTLVTVSS

SEQ ID NO: 4612 - protein, 129 aa, Artificial Sequence
  Description of Artificial Sequence: Synthetic polypeptide
QLQLVESGGGVVQPGRSLTLSCAASGFTFSTYGMHWVRQAPGKGLEWLAVISFDGNYKYYADYVKGRFTISRDNSRDTLYLQMNSLRPEDTGVFYCAKEERARILRYFDWLAHAAFDVWGQGTLVTVSS

SEQ ID NO: 4613 - protein, 132 aa, Artificial Sequence
  Description of Artificial Sequence: Synthetic polypeptide
QVQLQESGPGLVKPSETLSLTCTVSGGSVSSGFNYWAWIRQPPGKGLEWIGYIYSSGSTSYNPSLKSRVTISIDRSKNQFSLKLSSVTAADTALYYCARAPDRRFTMNIFGGDFAPTGMDVWGQGTTVTVSS

SEQ ID NO: 4614 - protein, 127 aa, Artificial Sequence
  Description of Artificial Sequence: Synthetic polypeptide
EVQLVESGGGLVQPGRSLRLSCAASGFTFHDYAMHWVRQAPGKGLEWVSGINWNSGSRNYADSVKGRFSISRDNAKNSLYLQMNSLRTEDTALYFCAKAFSGGDAYNWGLWDYFDYWGQGTLVTVSS

SEQ ID NO: 4615 - protein, 121 aa, Artificial Sequence
  Description of Artificial Sequence: Synthetic polypeptide
QVQLVQSGAEVKKPGSSVKVSCKASGVIFNNKALSWVRQAPGQGLEWIGGIVATFGTPKYAQKFQGRVTLTADESTTTVYLELSSLRSEDTAIYYCARDAGYYSGSYYEQWGQGTLVTVSP

SEQ ID NO: 4616 - protein, 126 aa, Artificial Sequence
  Description of Artificial Sequence: Synthetic polypeptide
EVQLVESGAEMKKPGASVKVSCRASGYSFNGYYIHWVRQAPGQGLEWLGWINPTSGGTNYAQKFLAWVTMTRDTSISTAYMELTSLRSDDTAVYYCVRGEAVLQYFDWQINWFDTWGQGTLVIVSS

SEQ ID NO: 4617 - protein, 120 aa, Artificial Sequence
  Description of Artificial Sequence: Synthetic polypeptide
QVQLVQSGAEVRKPGSSVKVSCRTSGGIIRKYALSWVRQAPGQGLEWMGGIIAIFGTTNYAQKFQGRVTITADESTSTVYLELSSLRYEDTAIYYCAGSATYYESRFDYWGQGTLVTVSS

SEQ ID NO: 4618 - protein, 122 aa, Artificial Sequence
  Description of Artificial Sequence: Synthetic polypeptide
QVQLQESGPGLVTASQTLSLTCTVSGDSIRDSDYFWTWIRQSSGKGLEWLGYMYHTGDTYLNPSLKSRLSMSIDTSKNQFSLRLSSVTAADTAVYFCARRPNIFGYNWFDPWGQGFPVTISS

SEQ ID NO: 4619 - protein, 125 aa, Artificial Sequence
  Description of Artificial Sequence: Synthetic polypeptide
QVQLVQSGAELKKPGSSVKVSCKASGGIFNSYAISWLRQAPGQGLEWMGGINAIFATAEYAQNFQGRVTITADESTTTAYMELTSLRSDDTAVYYCARGQGYCISPNCPNWFDPWGQGTLVTVSS

SEQ ID NO: 4620 - protein, 126 aa, Artificial Sequence
  Description of Artificial Sequence: Synthetic polypeptide
QVQLVQSGAEVKKPGASVKVSCKASGYNFNTYSINWMRQAPGQGLEWMGGISSYQGHTNYAQKFQGRVTMTRDTSTNTAYMELRSLRLDDTAVYYCAREEGTYYDFWSANNWFDPWGQGTLVTVSS

SEQ ID NO: 4621 - protein, 129 aa, Artificial Sequence
  Description of Artificial Sequence: Synthetic polypeptide
QVQLVESGAEVRKPGSSVKVSCKASGGTFSTFVINWVRQAPGQGLEWMGGIIPMFGAANYGQRLQGRVTITADESTRTGYMELRRLRSDDTAVYYCAKAQYYDSPRDAADFYFYAMDVWGQGTTVTVSS

SEQ ID NO: 4622 - protein, 119 aa, Artificial Sequence
  Description of Artificial Sequence: Synthetic polypeptide
QITLRESGPTLVKPTQTLTLTCTFSGFSLSTSGVGVGWIRQPPGKAPQLLALIYWDDDKRYSPSLKTRLTITKDTSKNQVVLTMTNMDPVDTATYFCALNVPPRPFDHWGPGSLVTVSS

SEQ ID NO: 4623 - protein, 120 aa, Artificial Sequence
  Description of Artificial Sequence: Synthetic polypeptide
QVQLVESGAEVKKPGSSVKVSCKASGGPFISYAIAWVRQAPGQGLEWMGGINPVFGAPNYAQKFQGRVTITADESTSTTYMELSSLRSEDTAIYFCAKRYSSGWYSFDYWGQGTLVTVSS

SEQ ID NO: 4624 - protein, 120 aa, Artificial Sequence
  Description of Artificial Sequence: Synthetic polypeptide
QVQLVQSGAEVRKPGSSVKVSCRTSGGIIRKYALSWVRQAPGQGLEWMGGIIAIFGTTNYAQKFQGRVTITADESTSTVYLELSSLRSEDTAIYYCAGSATYYESRFDYWGQGTLVTVSS

SEQ ID NO: 4625 - protein, 227 aa, Artificial Sequence
  Description of Artificial Sequence: Synthetic polypeptide
VQLVESGGGVVQPGKSPRLSCAASGPTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 4626 - protein, 222 aa, Artificial Sequence
  Description of Artificial Sequence: Synthetic polypeptide
EVHLQQSGPELVKPGASVKMSCKTSGYTFTEYTIHWMKQSHGKSLEWIGGIFPNNGDTTYNQKFKVRATLTVGRSSSTAYMDLRSLTSEDSAVYYCVRNYGSSYGYFDVWGAGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDC

SEQ ID NO: 4627 - protein, 124 aa, Artificial Sequence
  Description of Artificial Sequence: Synthetic polypeptide
QVQLVESGGNLVQPGGSLRLSCAASGFIFSNYALTWVRQAPGKGLEWVSSVTGGGSSTYYADSLKGRFTISRDNSKNMLYLQMNSLRPEDTAVYYCAKSVETQYFYDSNGYAYWGRGTPVTVSS

SEQ ID NO: 4628 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4629 - protein, 110 aa, Artificial Sequence
  Description of Artificial Sequence: Synthetic polypeptide
EIVMTQSPFSLSLSPGDRATLSCRASQSVTNSYLAWYQQKPGQAPRLLISGASSRATGIPDRFSGSGSGTDFTLTISRLEPEDFAVYYCQQYSSSPRTFGQGTKVEIKRT

SEQ ID NO: 4630 - protein, 110 aa, Artificial Sequence
  Description of Artificial Sequence: Synthetic polypeptide
EIVMTQSPATVSVSPGERATLSCRASQSVSNNLAWYQQKPGQAPRLLIYGASTRATGIPARFSGSGSGTEFTLTISSLQSEDFAIYYCQQYHNWPPLTFGGGTKVEIKRT

SEQ ID NO: 4631 - protein, 236 aa, Artificial Sequence
  Description of Artificial Sequence: Synthetic polypeptide
MDMRVLAQLLGLLLLWLRGARCDIQMTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4632 - protein, 128 aa, Artificial Sequence
  Description of Artificial Sequence: Synthetic polypeptide
MDMRVLAQLLGLLLLWLRGARCDIQMTQSPSSLSASVGDRVTITCRTSQSISSYLNWYQQKPGKAPKLLIYAASSLQSGVPSRFSGSGSGTDFTLTISGLQPEDFATYYCQQSYSMPAFGQGTKLEIK

SEQ ID NO: 4633 - protein, 107 aa, Artificial Sequence
  Description of Artificial Sequence: Synthetic polypeptide
DIQLTQSPVSLSLSPGERATLSCRASQSVSSSYLVWYQQKPGQAPRLLIYGASSRAPGIPDRFSGSGSGTDFTLTISRLEREDFAVYYCQQYGRSFGQGTKVEIKRT

SEQ ID NO: 4634 - protein, 107 aa, Artificial Sequence
  Description of Artificial Sequence: Synthetic polypeptide
EIVLTQSPGTLSLSPGERATLSCRASQSVDSNYLGWYQQRPGQAPRLLIYGASSRATGVPDRFSASGSGTDFTLSISRLEPEDFAVYYCQQYGSSFGQGTKVEIKRT

SEQ ID NO: 4635 - protein, 109 aa, Artificial Sequence
  Description of Artificial Sequence: Synthetic polypeptide
DILMTQSPSSMSVSLGDTVSITCHASQDISSNMGWLQQKPGKSLKGLIYHGTNLEDGVPSRFSGSGSGPDYSLTISSLESEDFADYYCVQYIQFPWTFGGGTKLEIKRA

SEQ ID NO: 4636 - protein, 108 aa, Artificial Sequence
  Description of Artificial Sequence: Synthetic polypeptide
DIVMTQSQKFMSASVGDRVSVTCKASQNVGTHLAWYQQKPGQSPKALIYSASYRYSGVPDRFTGSGSGTDFTLTISNVQSGDLADYFCQQYNNFPLTFGAGTKLEIKR

SEQ ID NO: 4637 - protein, 108 aa, Artificial Sequence; identical to SEQ ID NO: 4636
  Description of Artificial Sequence: Synthetic polypeptide

SEQ ID NO: 4638 - protein, 107 aa, Artificial Sequence
  Description of Artificial Sequence: Synthetic polypeptide
DIQMTQSPSSLSASVGDRVTISCQASQDITNFLNWYQQKSGEAPKLLIYDASDLETGVPSRFSGSGSGTDFTFTISRLQPEDTATYYCQQYDDLPYTFGQGTKVEIK

SEQ ID NO: 4639 - protein, 218 aa, Artificial Sequence
  Description of Artificial Sequence: Synthetic polypeptide
DIVLTQSPGSLTVSLGQRATISCRASESVDNFGKSFMHWYQQKPGQSPKLLIYRASNREFGIPARFNGSGSGTDFALTINPVEADDVATYFCQQSNEDPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 4640 - protein, 217 aa, Artificial Sequence
  Description of Artificial Sequence: Synthetic polypeptide
  MOD_RES (215)..(215): Any amino acid
QLVLTQSPSASASLGASVKLTCTLSSRHSDYAIGWHQQQPGKGPRYLMKLNPDGSHTKGDGIPDRFSGSSSGAERYLTISNLLSEDEADYYCQTWGTGIQVFGGGTRLTVISQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTXCS

SEQ ID NO: 4641 - protein, 234 aa, Artificial Sequence [sequence omitted]

SEQ ID NO: 4642 - protein, 237 aa, Artificial Sequence [sequence omitted]

SEQ ID NO: 4643 - protein, 126 aa, Artificial Sequence
  Description of Artificial Sequence: Synthetic polypeptide
MAWFPLFLGVLAYCTGSMASYELTQPPSVSVSPGQTASITCSGDKLGDKFVSWYHQKPGQSPLKVIYQDNRRPSGIPERFSGSNSGNTATLTISGTQAMDEADYYCQTWDSSTVVFGGGTKLTVLG

SEQ ID NO: 4644 - protein, 113 aa, Artificial Sequence
  Description of Artificial Sequence: Synthetic polypeptide
QSVLTQPPSVSGAPGQRVTISCTGSSSNIGAGYDVHWYQLLPGTAPKLLIYAFSDRPSGVPDRFSGSKSGTSASLAITGLQAEDEGDYYCQSYDTGLSGLEVVFGGGTKLTVL

SEQ ID NO: 4645 - protein, 217 aa, Artificial Sequence
  Description of Artificial Sequence: Synthetic polypeptide
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4646 - protein, 214 aa, Artificial Sequence
  Description of Artificial Sequence: Synthetic polypeptide
EIVLTQSPATLSLSPGERATLSCRASENIWNNLAWYQQKPGQAPRLLISGASTGATGVPSRFRGSGSRTEFTLTISSLQSEDFAIYFCQQYNSWPRTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4647 - protein, 215 aa, Artificial Sequence
  Description of Artificial Sequence: Synthetic polypeptide
EVVLTQSPGTLALPPGERATLSCRASHRVGSTYIAWYQQKSGQAPRRLIYGASNRATDIPDRFSGSGSGTDFTLTIRRLEPEDSAVYYCQQFSVSPWTFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4648 - protein, 114 aa, Artificial Sequence
  Description of Artificial Sequence: Synthetic polypeptide
EIVLTQSPATLSLYPGERATLSCRASQSVSRYLAWYQQKPGQAPRLLIYDASNRATGIPARFSGSGSGTDFTLTISSLEPEDFAVYYCCDRQQRSNWLKITFGQGTRLEIKGTV

SEQ ID NO: 4649 - protein, 115 aa, Artificial Sequence
  Description of Artificial Sequence: Synthetic polypeptide
DIVMTQSPLSLPVTPGEPASISCRSSQSLLHSNGHIYFDWYLQKPGQSPQLLIYLVSKRASGVPDRFSGSGSGTDFTLKISRVEAEDVGVYYCMQALETPFTFGPGTKVHIKRTV

SEQ ID NO: 4650 - protein, 115 aa, Artificial Sequence
  Description of Artificial Sequence: Synthetic polypeptide
QSALTQPASVSGSPGQSITISCTGTSSDVGAYNYVSWYQHHPGKAPKLMIYDVTYRPSGVSTRFSGSKSGNTASLTISGLQAEDEADYYCSSQSRSSTLVIFGGGTKLTVLGQPK

SEQ ID NO: 4651 - protein, 112 aa, Artificial Sequence
  Description of Artificial Sequence: Synthetic polypeptide
EIVLTQSPGTLSLSPGERATLSCRASQSVSSSYLAWYQQKPGQAPRLLIYGASTRATGIPDRFSGRGSGTDFTLTISSLEPEDFAVYYCQNYGSPFLFTFGPGTKVDIKRTV

SEQ ID NO: 4652 - protein, 111 aa, Artificial Sequence
  Description of Artificial Sequence: Synthetic polypeptide
EIVLTQSPGTLSLSPGERATLSCRASQSVSSSYLAWYQQKPGQAPRLLIFGASTRATGIPDRFSGSGSGTDFTLTISRLEPEDFAVFYCQQYGSLPLTFGGGTKVEIKGTV

SEQ ID NO: 4653 - protein, 235 aa, Artificial Sequence
  Description of Artificial Sequence: Synthetic polypeptide
METPAQLLFLLLLWLPDTTGEIVLTQSPGTLSLSPGERATLSCRASQSLSSSSLVWYQQKPGQAPRLLIYGASSRATGIPDRFSGSGSGTDFTLTISRLEPEDFAVYYCQQYGNSPYTFGQGTQVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4654 - protein, 234 aa, Artificial Sequence
  Description of Artificial Sequence: Synthetic polypeptide
MEAPAQLLFLLLLWLPDTTGEIVLTQSPATLSLSPGERATLSCRASENIWNNLAWYQQKPGQAPRLLISGASTGATGVPSRFRGSGSRTEFTLTISSLQSEDFAIYFCQQYNSWPRTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4655 - protein, 235 aa, Artificial Sequence
  Description of Artificial Sequence: Synthetic polypeptide
METPAQLLFLLLLWLPDTTGETVLTQSPGTLSLSPGERATLSCRASQSVSISYLAWYQRKPGQAPRLLIYGASRRATGIPDRFSGSGSGTDFTLTISRLEPEDFAVYYCQQYGSSPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4656 - protein, 111 aa, Artificial Sequence
  Description of Artificial Sequence: Synthetic polypeptide
LPVLTQSSSASASLGSSVKLTCTLSSGHSNYIIAWHQQQPGKAPRYLMKVNSDGSHTKGDGIPDRFSGSSSGADRYLTISNLQSEDEASYFCETWDTKIHVFGTGTKVSVL

SEQ ID NO: 4657 - protein, 219 aa, Artificial Sequence
  Description of Artificial Sequence: Synthetic polypeptide
QSVLTQPPSVSGAPGQRVTISCTGSSSNIGAGYAVHWYQQLPGTAPKLLISGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVHEGSTVEKTVAPTECSARQ

SEQ ID NO: 4658 - protein, 106 aa, Artificial Sequence
  Description of Artificial Sequence: Synthetic polypeptide
SYELTQLPSVSVSPGQTATITCSGDRLGDKYACWYQQKPGQSPVLVIFQDTKRPSGIPERFSGSNSGNTATLTISGTQAMDEADYYCQAWDSNIGVFGGGTKLTVL

SEQ ID NO: 4659 - protein, 110 aa, Artificial Sequence
  Description of Artificial Sequence: Synthetic polypeptide
DIVMTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPKWISN

SEQ ID NO: 4660 - protein, 110 aa, Artificial Sequence
  Description of Artificial Sequence: Synthetic polypeptide
DIQMTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWRSN

SEQ ID NO: 4661 - protein, 217 aa, Artificial Sequence
  Description of Artificial Sequence: Synthetic polypeptide
QPVLTQPPSASGTPGQRVTISCSGSSSNIGSNTVSWYQQVPGTAPKLLIYGNNERPSGVPDRFSGSKSATSASLAISGLQSEDEADYYCAAWDDSLNGFWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 4662 - protein, 217 aa, Artificial Sequence
  Description of Artificial Sequence: Synthetic polypeptide
QPVLTQPPSASGSPGQRVTISCSGSSSNIGSYTVNWYQQLPGTAPKLLIYSLNQRPSGVPDRFSGSKSGTSASLAISGLQSEDEAVYYCAAWDDSLSAHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4663 - protein, 214 aa, Artificial Sequence
  Description of Artificial Sequence: Synthetic polypeptide
SYVLTQPPSVSVAPGETATVTCGGNNIGSKSVHWYQQKPGQAPVVVIYYDGDRPSGIPERFSGSNSGDTATLTISRVEAGDEADYYCLVWDYTSVHYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 4664 - protein, 218 aa, Artificial Sequence
  Description of Artificial Sequence: Synthetic polypeptide
EIVMTQSPDSLAVSLGERATINCKSSQSVTYNYKNYLAWYQQKPGQPPKLLIYWASTRESGVPDRFSGSGSGTDFTLTISSLQAEDVAVYYCQQYYRTPPTFGGGTKLDIKGSVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4665 - protein, 111 aa, Artificial Sequence
  Description of Artificial Sequence: Synthetic polypeptide
EIVMTQSPDSLAVSLGERATINCKSSQSVTYNYKNYLAWYQQKPGQPPKLLIYWASTRESGVPDRFSGSGSGTDFTLTISSLQAEDVAVYYCQQYYRTPPTFGGGTKLDIK

SEQ ID NO: 4666 - protein, 111 aa, Artificial Sequence
  Description of Artificial Sequence: Synthetic polypeptide
DIQMTQSPSSLSASVGDRVTITCRSSQSITFQYKNYLAWYQQKPGKAPKLLIYWGSYLESGVPSRFSGSGSGTDFTLTISSLQPEDFATYYCQQHYRTPPSFGQGTKVEIK

SEQ ID NO: 4667 - protein, 111 aa, Artificial Sequence
  Description of Artificial Sequence: Synthetic polypeptide
DIQMTQSPSSLSASVGDRVTITCRSSQSITFRYKNYLAWYQQKPGKAPKLLIYWGSYLESGVPSRFSGSGSGTDFTLTISSLQPEDFATYYCQQHYRTPPSFGQGTKVEIK

SEQ ID NO: 4668 - protein, 111 aa, Artificial Sequence
  Description of Artificial Sequence: Synthetic polypeptide
DIQMTQSPSSLSASVGDRVTITCRSSQSITFEYKNYLAWYQQKPGKAPKLLIYWGSYLESGVPSRFSGSGSGTDFTLTISSLQPEDFATYYCQQHYRTPPSFGQGTKVEIK

SEQ ID NO: 4669 - protein, 111 aa, Artificial Sequence
  Description of Artificial Sequence: Synthetic polypeptide
DIQMTQSPSSLSASVGDRVTITCRSSQSITFDYKNYLAWYQQKPGKAPKLLIYWGSTRESGVPSRFSGSGSGTDFTLTISSLQPEDFATYYCQQHYRTPPSFGQGTKVEIK

SEQ ID NO: 4670 - protein, 111 aa, Artificial Sequence
  Description of Artificial Sequence: Synthetic polypeptide
DIQMTQSPSSLSASVGDRVTITCRSSQSITWNYKNYLAWYQQKPGKAPKLLIYWGSYLESGVPSRFSGSGSGTDFTLTISSLQPEDFATYYCQQHYRTPPSFGQGTKVEIK

SEQ ID NO: 4671 - protein, 111 aa, Artificial Sequence
  Description of Artificial Sequence: Synthetic polypeptide
DIQMTQSPSSLSASVGDRVTITCRSSQSITWDYKNYLAWYQQKPGKAPKLLIYWGSYLESGVPSRFSGSGSGTDFTLTISSLQPEDFATYYCQQHYRTPPSFGQGTKVEIK

SEQ ID NO: 4672 - protein, 111 aa, Artificial Sequence
  Description of Artificial Sequence: Synthetic polypeptide
DIQMTQSPSSLSASVGDRVTITCRSSQSITWQYKNYLAWYQQKPGKAPKLLIYWGSYLESGVPSRFSGSGSGTDFTLTISSLQPEDFATYYCQQHYRTPPSFGQGTKVEIK

SEQ ID NO: 4673 - protein, 111 aa, Artificial Sequence
  Description of Artificial Sequence: Synthetic polypeptide
DIQMTQSPSSLSASVGDRVTITCRSSQSITWRYKNYLAWYQQKPGKAPKLLIYWGSYLESGVPSRFSGSGSGTDFTLTISSLQPEDFATYYCQQHYRTPPSFGQGTKVEIK

SEQ ID NO: 4674 - protein, 111 aa, Artificial Sequence
  Description of Artificial Sequence: Synthetic polypeptide
DIQMTQSPSSLSASVGDRVTITCRSSQSITWEYKNYLAWYQQKPGKAPKLLIYWGSYLESGVPSRFSGSGSGTDFTLTISSLQPEDFATYYCQQHYRTPPSFGQGTKVEIK

SEQ ID NO: 4675 - protein, 111 aa, Artificial Sequence
  Description of Artificial Sequence: Synthetic polypeptide
EIVMTQSPDSLAVSLGERATINCKSSQSVTFSYKNYLAWYQQKPGQPPKLLIYWASTRESGVPDRFSGSGSGTDFTLTISSLQAEDVAVYYCQQYYRTPPTFGGGTKLDIK

SEQ ID NO: 4676 - protein, 111 aa, Artificial Sequence
  Description of Artificial Sequence: Synthetic polypeptide
EIVMTQSPDSLAVSLGERATINCKSSQSVTFDYKNYLAWYQQKPGQPPKLLIYWASTRESGVPDRFSGSGSGTDFTLTISSLQAEDVAVYYCQQYYRTPPTFGGGTKLDIK

SEQ ID NO: 4677 - protein, 111 aa, Artificial Sequence
  Description of Artificial Sequence: Synthetic polypeptide
EIVMTQSPDSLAVSLGERATINCKSSQTVTFNYKNYLAWYQQKPGQPPKLLIYWASTRESGVPDRFSGSGSGTDFTLTISSLQAEDVAVYYCQQHYRTPPSFGGGTKLDIK

SEQ ID NO: 4678 - protein, 111 aa, Artificial Sequence
  Description of Artificial Sequence: Synthetic polypeptide
EIVMTQSPDSLAVSLGERATINCKSSQTLSFNYKNYLAWYQQKPGQPPKLLIYWASTRESGVPDRFSGSGSGTDFTLTISSLQAEDVAVYYCQQHYRTPPSFGGGTKLDIK

SEQ ID NO: 4679 - protein, 111 aa, Artificial Sequence
  Description of Artificial Sequence: Synthetic polypeptide
EIVMTQSPDSLAVSLGERATINCKSSQTVTFNYKNYLAWYQQKPGQPPKLLIYFASTRESGVPDRFSGSGSGTDFTLTISSLQAEDVAVYYCQQHYRTPPSFGGGTKLDIK

SEQ ID NO: 4680 - protein, 111 aa, Artificial Sequence
  Description of Artificial Sequence: Synthetic polypeptide
EIVMTQSPDSLAVSLGERATINCKSSQTLSFNYKNYLAWYQQKPGQPPKLLIYFASTRESGVPDRFSGSGSGTDFTLTISSLQAEDVAVYYCQQHYRTPPSFGGGTKLDIK

SEQ ID NO: 4681 - protein, 111 aa, Artificial Sequence
  Description of Artificial Sequence: Synthetic polypeptide
EIVMTQSPDSLAVSLGERATINCKSSQSVTWSYKNYLAWYQQKPGQPPKLLIYWASTRESGVPDRFSGSGSGTDFTLTISSLQAEDVAVYYCQQYYRTPPTFGGGTKLDIK

SEQ ID NO: 4682 - protein, 111 aa, Artificial Sequence
  Description of Artificial Sequence: Synthetic polypeptide
EIVMSQSPDTLAVTLGERASINCKSSQTVTFNYKNYLAWYQQKPGQPPKVLIYWASARETGVPERFSGSGSGTDFTLTISSLQAEDVAVYYCQQHYRTPPSFGQGTKLEIK

SEQ ID NO: 4683 - protein, 111 aa, Artificial Sequence
  Description of Artificial Sequence: Synthetic polypeptide
EIVMTQSPDSLAVSLGERATINCKSSQTVTFNYKNYLAWYQQKPGQPPKLLIYWASTRESGVPDRFSGSGSGTDFTLTISSLQAEDVAVYYCQQHYRTPPSFGTGTKLDIK

SEQ ID NO: 4684 - protein, 111 aa, Artificial Sequence
  Description of Artificial Sequence: Synthetic polypeptide
EIVMTQSPDSLAVSLGERATINCKSSQTVTFNYKNYLAWYQQKPGQPPKLLIYWASTRESGVPDRFSGSGSGTDFTLTISSLQAEDVAVYYCQQHYRTPPSFGSGTKLDIK

SEQ ID NO: 4685 - protein, 111 aa, Artificial Sequence
  Description of Artificial Sequence: Synthetic polypeptide
EIVMTQSPDSLAVSLGERATINCKSSQTVTFNYKNYLAWYQQKPGQPPKLLIYWASTRESGVPDRFSGSGSGTDFTLTISSLQAEDVAVYYCQQHYRTPPSFGQGTKLDIK

SEQ ID NO: 4686 - protein, 111 aa, Artificial Sequence
  Description of Artificial Sequence: Synthetic polypeptide
EIVMTQSPDSLAVSLGERATINCKSSQTVTFNYKNYLAWYQQKPGQPPKLLIYWASTRESGVPDRFSGSGSGTDFTLTISSLQAEDVAVYYCQQHYRTPPSFGNGTKLDIK

SEQ ID NO: 4687 - protein, 111 aa, Artificial Sequence
  Description of Artificial Sequence: Synthetic polypeptide
EIVMTQSPDSLAVSLGERATINCKSSQTLSFNYKNYLAWYQQKPGQPPKLLIYWASTRESGVPDRFSGSGSGTDFTLTISSLQAEDVAVYYCQQHYRTPPSFGTGTKLDIK

SEQ ID NO: 4688 - protein, 111 aa, Artificial Sequence
  Description of Artificial Sequence: Synthetic polypeptide
EIVMTQSPDSLAVSLGERATINCKSSQTLSFNYKNYLAWYQQKPGQPPKLLIYWASTRESGVPDRFSGSGSGTDFTLTISSLQAEDVAVYYCQQHYRTPPSFGSGTKLDIK

SEQ ID NO: 4689 - protein, 111 aa, Artificial Sequence
  Description of Artificial Sequence: Synthetic polypeptide
EIVMTQSPDSLAVSLGERATINCKSSQTLSFNYKNYLAWYQQKPGQPPKLLIYWASTRESGVPDRFSGSGSGTDFTLTISSLQAEDVAVYYCQQHYRTPPSFGQGTKLDIK

SEQ ID NO: 4690 - protein, 111 aa, Artificial Sequence
  Description of Artificial Sequence: Synthetic polypeptide
EIVMTQSPDSLAVSLGERATINCKSSQTLSFNYKNYLAWYQQKPGQPPKLLIYWASTRESGVPDRFSGSGSGTDFTLTISSLQAEDVAVYYCQQHYRTPPSFGNGTKLDIK

SEQ ID NO: 4691 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSYLESGVPSRFSGSGSGTDFTLTISSLQPEDFATYYCQQHYRTPPSFGQGTKVEIK

SEQ ID NO: 4692 - protein, 111 aa, Artificial Sequence
  Description of Artificial Sequence: Synthetic polypeptide
DIQMTQSPSSLSASVGDRVTITCRSSQSITFNYKNYLGWYQQKPGKAPKLLIYWGSYLESGVPSRFSGSGSGTDFTLTISSLQPEDFATYYCQQHYRTPPSFGQGTKVEIK

SEQ ID NO: 4693 - protein, 111 aa, Artificial Sequence
  Description of Artificial Sequence: Synthetic polypeptide
DIVMTQSPDTLAVTLGERATIQCKSSQTVTFNYKNYLAWYQQKPGQPPKLLIYWASTRESGVPDRFSGSGSGTDFTLTITSLQAEDVAVYYCQQHYRTPPSFGQGTKLDIK

SEQ ID NO: 4694 - protein, 111 aa, Artificial Sequence
  Description of Artificial Sequence: Synthetic polypeptide
DIVMTQSPDTVAVTVGERATINCKSSQTVTFNYKNYLAWYQQKPGQPPKLLIYWASTRESGVPDRFSGSGSGTDFTLTISSLQAEDVAVYYCQQHYRTPPSFGQGTKLDIK

SEQ ID NO: 4695 - protein, 111 aa, Artificial Sequence
  Description of Artificial Sequence: Synthetic polypeptide
DIVMTQSPDTVAVTLGERATIDCKSSQTVTFNYKNYLAWYQQKPGQPPKLLIYWASTRESGVPDRFSGSGSGTDFTLTISSLQAEDVAVYYCQQHYRTPPSFGQGTKLDIK

SEQ ID NO: 4696 - protein, 111 aa, Artificial Sequence
  Description of Artificial Sequence: Synthetic polypeptide
DIVMTQSPDTLAVTVGERATIRCKSSQTVTFNYKNYLAWYQQKPGQPPKLLIYWASTRESGVPDRFSGSGSGTDFTLTISSLQAEDVAVYYCQQHYRTPPSFGQGTKLDIK

SEQ ID NO: 4697 - protein, 111 aa, Artificial Sequence
  Description of Artificial Sequence: Synthetic polypeptide
DIVMTQSPDTLAVSRGERATIDCKSSQTVTFNYKNYLAWYQQKPGQPPKLLIYWASTRESGVPDRFSGSGSGTDFTLTISSLQAEDEAVYYCQQHYRTPPSFGQGTKLDIK

SEQ ID NO: 4698 - protein, 111 aa, Artificial Sequence
  Description of Artificial Sequence: Synthetic polypeptide
DIQMTQSPSSLSASVGDRVTITCRSSQSITFDYKNYLAWYQQKPGKAPKLLIYWGSYLESGVPSRFSGSGSGTDFTLTISSLQPEDFATYYCQQHYRTPPSFGQGTKVEIK

SEQ ID NO: 4699 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSTLESGVPSRFSGSGSGTDFTLTISSLQPEDFATYYCQQHYRTPPSFGQGTKVEIK

SEQ ID NO: 4700 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSHLESGVPSRFSGSGSGTDFTLTISSLQPEDFATYYCQQHYRTPPSFGQGTKVEIK

SEQ ID NO: 4701 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSKLESGVPSRFSGSGSGTDFTLTISSLQPEDFATYYCQQHYRTPPSFGQGTKVEIK

SEQ ID NO: 4702 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSDLESGVPSRFSGSGSGTDFTLTISSLQPEDFATYYCQQHYRTPPSFGQGTKVEIK

SEQ ID NO: 4703 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSYLESGVPSRFSGSGSGTDFTLTISSLQPEDVATYYCQQHYRTPPSFGQGTKVEIK

SEQ ID NO: 4704 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSYLESGVPSRFSGSGSGTDFTLTISSLQPEDKATYYCQQHYRTPPSFGQGTKVEIK

SEQ ID NO: 4705 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSYLESGVPSRFSGSGSGTDFTLTISSLQPEDDATYYCQQHYRTPPSFGQGTKVEIK

SEQ ID NO: 4706 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSYLESGVPSRFSGSGSGTDFTLTISSLQPEDFATYYCQQYYRTPPSFGQGTKVEIK

SEQ ID NO: 4707 - protein, 111 aa, Artificial Sequence
  Description of Artificial Sequence: Synthetic polypeptide
DIQMTQSPSSLSASVGDRVTITCRSSQSITFNYKNYLAWYQQKPGKAPKLLIYWGSTRESGVPSRFSGSGSGTDFTLTISSLQPEDFATYYCQQHYRTPPSFGQGTKVEIK

SEQ ID NO: 4708 - protein, 219 aa, Artificial Sequence; identical to SEQ ID NO: 4657
  Description of Artificial Sequence: Synthetic polypeptide

SEQ ID NO: 4709 - protein, 110 aa, Artificial Sequence
  Description of Artificial Sequence: Synthetic polypeptide
EIVMTQSPATLSVSPGERVTLSCRASQSITDGLAWYQQKSGQAPRLLIYGASTRATGIPARFSGSGSGTEFTLTISSLQSEDFAVYYCQQYNNWPPVTFGQGTKVEIKRT

SEQ ID NO: 4710 - protein, 216 aa, Artificial Sequence
  Description of Artificial Sequence: Synthetic polypeptide
QSALTQPASVSGSPGQSITISCTGTSSDVGSYNLVSWYQQHPGKAPKLMIYEVSKRPSGVSNRFSGSKSGNTASLTISGLQAEDEADYYCHLYVGSSNWVFGGGTKLAVLGQPKAAPSVTLFPPSSKELQANKATLVCPISDFYPGAVTVAWKADSSPVKAGVETTTPSKQSNNKYAASSYLSLTPEQWKSHKSYSCQVTHEGSTVEKTVAPTECS

SEQ ID NO: 4711 - protein, 111 aa, Artificial Sequence
  Description of Artificial Sequence: Synthetic polypeptide
DIQLTQSPSSLSASAGDRVSMTCRASQIISSSLNWYQQKPGKAPKLLIYAASNLQSGVPSRFSGSGSGTDFTLTISSLQPEDFATYYCQQSYSTPPELTFGGGTKVDIKRT

SEQ ID NO: 4712 - protein, 109 aa, Artificial Sequence
  Description of Artificial Sequence: Synthetic polypeptide
AIQMTQSPSSLSASVGDRVTITCRASQNIRSYLNWYQQKPGKAPNLLIYGTTSLESGVPSRFSGSGSGTDFTLTISSLQPEDFATYYCQQSYHTPQTFGQGTKVEIKRT

SEQ ID NO: 4713 - protein, 109 aa, Artificial Sequence
  Description of Artificial Sequence: Synthetic polypeptide
DIQLTQSPSSLSASVGDRVTITCRASQGITDYLAWYQQKPGTIPKLLIYAASTLQSGVPSRFSGGGYGTDFTLTISSLQPEDVATYYCQKYNSAPLTFGGGTKVEIKRT

SEQ ID NO: 4714 - protein, 109 aa, Artificial Sequence
  Description of Artificial Sequence: Synthetic polypeptide
DIVMTQSPFSLSLSPGERATLSCRASQSISNYLAWYQQKPGQAPRLLIYDSSNRATGVPARFSGSGSGTDFTLTISSLEPEDFAVYYCQQRSNWMYTFGQGTKVEIKRT

SEQ ID NO: 4715 - protein, 237 aa, Artificial Sequence [sequence omitted]

SEQ ID NO: 4716 - protein, 109 aa, Artificial Sequence
  Description of Artificial Sequence: Synthetic polypeptide
DIQMTQSPSSLSASVGDRITITCRASQGIDNYLAWFQQKPGKVPELLIYAASTLQSGVPSRFSGSGSGTGFTLTISSLQPEDVATYYCQKYDSAPLTFGGGTKVDIKRT

SEQ ID NO: 4717 - protein, 110 aa, Artificial Sequence; identical to SEQ ID NO: 4709
  Description of Artificial Sequence: Synthetic polypeptide

SEQ ID NO: 4718 - protein, 234 aa, Artificial Sequence
  Description of Artificial Sequence: Synthetic polypeptide
MRFPAQFLGLLLVWLTGARCDIQMTQSPASLSESVGETVTITCRASENIYSYLAWYQQKQGKSPQLLVYFAKTLAEGVPSTFSGSGSGTLFSLKINSLQPEDFGNYYCQHHYGTPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 4719 - protein, 238 aa, Artificial Sequence
  Description of Artificial Sequence: Synthetic polypeptide
MKLPVRLLVLMFWIPASSSDVVMTQTPLSLPVSLGDQASISCRSSQSLVHSNGNTYLHWYLQKPGQSPKLLIYKVSNRFSGVPDRFSGSGSGTDFTLKISRVEAEDLGVYFCSQSTHVPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 4720 - protein, 238 aa, Artificial Sequence
  Description of Artificial Sequence: Synthetic polypeptide
METDTLLLWVLLLWVPGSTGDIVLTQSPASLAVSLGQRATISCRASESVDSYGNSFMHWYQQKPGQPPKVLIYRASNLESGIPARFSGSGSRTDFTLTINPVEADDVATYYCQQSNGDPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 4721 - protein, 242 aa, Artificial Sequence
  Description of Artificial Sequence: Synthetic polypeptide
SKLATMETDTLLLWVLLLWVPGSTGNIVLTQSPASLAVSLGQRATISCKASESVDSYGTSFMHWYQQKPGQPPKLLIYLASNLESGVPARFSGSGSRTDFTLTIDPVEADDAATYYCQQNNEHPMFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 4722 - protein, 234 aa, Artificial Sequence
  Description of Artificial Sequence: Synthetic polypeptide
LETTLTQSPATLSVSPGERATLSCRASQSVSSNLAWYQQKPGQAPRLLIYGASTRATGIPARFSGSGSGTDFTLTISSLQSEDFAVYYCQQNYNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGECAPGSLHHILDAQKMVWNHR

SEQ ID NO: 4723 - protein, 324 aa, Artificial Sequence
  Description of Artificial Sequence: Synthetic polypeptide
GAGCTCCAGATGACCCAGTCTCCGTCCTCCCTGTCTGCATCTCTAGGAGACAGAGTCACCATCACTTGCCGGGCAAGTCAGGACATTACCACCTATTTAAATTGGTATCAACAGAAACCAGGGAAAGCCCCTAACCTCCTGATCTCTCTTGCATCCACTTTACAAAGTGGGGTCCCATCAAGGTTCAGTGGCAGGGGATCTGGGACAGATTTCACTCTCACCATCAACGGTCTCCAACCTGAAGATTTTGCAACTTACTACTGTCAACAGAGTTACAGGACCCCTCCGACGTTCGGCCAAGGGACCAAGGTGGACATCAAGCGA

SEQ ID NO: 4724 - protein, 324 aa, Artificial Sequence
  Description of Artificial Sequence: Synthetic polypeptide
GAGCTCCAGATGACCCAGTCTCCATCTTCCGTGTCTGCATCTGTAGGAGACAGAGTCACCATCACTTGTCGGGCGAGTCAGGGTATTAGCAGCTGGTTAGCCTGGTATCAGCAGAAACCAGGGAAAGCCCCTAAGCTCCTGATCTATGCTGCATCCAGTTTGCAAAGTGGGGTCCCATCAAGGTTCAGCGGCAGTGGATCTGGGACAGATTTCACTCTCACCATCAGCAGCCTGCAGCCTGAAGATTTTGCAACTTACTATTGTCAACAGGCTAACAGTTTCCCGCTCACTTTCGGCGGAGGGACCAAGGTGGAGATCAAACGA

SEQ ID NO: 4725 - protein, 215 aa, Artificial Sequence
  Description of Artificial Sequence: Synthetic polypeptide
QSVLTQPPSASGTPGQRVTISCSGSSSNIGSNDVYWYQNLPGTAPKLLIYNNNQRPSGVPDRFSGSKSGTSASLAISGLRSEDEADYYCAAWDDSLTVSFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVVPAECS

SEQ ID NO: 4726 - protein, 216 aa, Artificial Sequence
  Description of Artificial Sequence: Synthetic polypeptide
EIVLTQSPGTLSLSPGERATLSCRASQSVRSNNLAWYQHKPGQAPRLLIFGASSRATGIPDRFSGSGSGTDFTLTISRLEPEDFAVYYCQQYGSSPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4727 - protein, 215 aa, Artificial Sequence
  Description of Artificial Sequence: Synthetic polypeptide
DIQMTQSPSTLSASVGDRVTITCRASQTINNYLAWYQQKPGKAPKLLIYKASSLESGVPSRFSGSGSGTEFTLTISSLQPDDFATYYCQEYNNDSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4728 - protein, 214 aa, Artificial Sequence
  Description of Artificial Sequence: Synthetic polypeptide
DIELTQDPSVSVAPGQTARIPCVRFNMGPTSVHWYQQKPGQAPVLVVYDDSDRPSGIPERFSGSNSGDSATLTISRVEAGDEADYYCQVWDMSSDRRVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVVPAECS

SEQ ID NO: 4729 - protein, 214 aa, Artificial Sequence
  Description of Artificial Sequence: Synthetic polypeptide
DIVMTQSPATLSVSPGERATLSCRASQVVGTNLAWYQQKPGQAPRLLIYAASTRATGIPARFSGSGFGTDFTLTISSLQSEDFAVYYCQQYNNWPLSFGGGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4730 - protein, 214 aa, Artificial Sequence
  Description of Artificial Sequence: Synthetic polypeptide
DIQMTQSPSSLSASVGDRVTIVCRASQGINTHLHWYQQKPGKAPKLLIYSASTLHTGVPSRLSGSGSGTDFTLSISSLQPEDFATYYCQQSYNYPRTFGQGTNVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4731 - protein, 219 aa, Artificial Sequence
  Description of Artificial Sequence: Synthetic polypeptide
DIEMTQSPLSLPVTPGESASISCRSSQSLLHSNGYNYLDWYLQKPGQSPQLLIYLGSSRASGVPDRFSGSGSGTDFTLKISRVEAEDVGVYYCMQGLQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4732 - protein, 220 aa, Artificial Sequence
  Description of Artificial Sequence: Synthetic polypeptide
DIVLTQSPVSLAVSLGESATVNCKSSQSVLSNSKNLNYLAWYQHKPGQPPKLLIYWASTRESGVPDRFSGSGSGTDFTLTISSLQAEDVAVYYCQQHYSIPLTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4733 - protein, 214 aa, Artificial Sequence
  Description of Artificial Sequence: Synthetic polypeptide
DILMTQSPSSLSASVGDRVTITCRASQDIRNRLAWYQQKPGKAPKRLIYAASSLQSGVPSRFSGSGSGTEFTLTINSLQPEDFATYYCLQHNSYPWTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4734 - protein, 214 aa, Artificial Sequence
  Description of Artificial Sequence: Synthetic polypeptide
DIVMTQSPATLSVSPGEGATLSCRASQGIGSNLAWYQHKPGQAPRLLIYAASTRATGVPARFSGSGSGTEFTLTISSLQSEDLAVYFCQQYNTWPLTFGGGTKVEIIRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4735 - protein, 214 aa, Artificial Sequence
  Description of Artificial Sequence: Synthetic polypeptide
DIVMTQSPSTLSASVGDRVTITCRASQTIYRWLAWYQQKPGKAPKVLIYKASTLESGVPSRFSGSGSGTEFTLAISSLQPDDFATYYCQQYNSFPYRFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4736 - protein, 214 aa, Artificial Sequence
  Description of Artificial Sequence: Synthetic polypeptide
DIVMTQSPSSLSASVGDRVSITCRASQTITRFLNWYQQKPGKGPKLLIYAASTVHRGVPSRFSGSGSGTDFTLTISSLQPEDFATYYCQQSYSAPFTFGPGTTVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4737 - protein, 212 aa, Artificial Sequence
  Description of Artificial Sequence: Synthetic polypeptide
DIVLTQAPSVSVSPGQTASITCSGDRLGEKFASWYQQKPGQSPVLVIYEDSKRPSGIPDRFSGSNSGNTATLTISGTQIMDEGDFFCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVVPAECS

SEQ ID NO: 4738 - protein, 212 aa, Artificial Sequence
  Description of Artificial Sequence: Synthetic polypeptide
DIELTQSPSVSVSPGQTASITCSGDKLGDKFVCWYQQKAGQSPIVVIYQDDKRPSGIPERFSGSNSGNTATLTISGTQAMDEADYFCQAWDSTTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVVPAECS

SEQ ID NO: 4739 - protein, 216 aa, Artificial Sequence
  Description of Artificial Sequence: Synthetic polypeptide
DIELTQEPSASGTPGQRVTISCSGDTSNIGSNTVSWFQLLPGTAPKLLIFTDNQRPSGVPGRFSGSKSGTSASLAISGLQSEDETDYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVVPAECS

SEQ ID NO: 4740 - protein, 454 aa, Artificial Sequence
  Description of Artificial Sequence: Synthetic polypeptide
QVQLVQSGAEVKKPGSSVTVSCKTSGHTFISYAISWLRQAPGQGLEWMGGIVPIFGTVNYTQKFQGRLTITADESTSTAYMDLSRLTFEDTAIYFCAREAGYHSSFSGVYFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4741 - protein, 452 aa, Artificial Sequence
  Description of Artificial Sequence: Synthetic polypeptide
QVQLVQSGGGVVQRGRSLRLSCAASGFTFRTYGMHWVRQAPGKGLECVALISYDGTNKYYADSVKGRFTISRDNSKDTLYLQMNSLRAEDTGVYYCASLDYDFSYYYHRDVWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4742 - protein, 450 aa, Artificial Sequence
  Description of Artificial Sequence: Synthetic polypeptide
QVQLVESGGGVVQPGRSLRLSCAASGFTFSSYGIYWVRQAPGKGLEWVAFISYDEINKFYADSVKGRFTISRDNSKNTVFLQMNSLRDEDTAVYYCAKPLRGSYRYFDLWGRGTVVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4743 - protein, 453 aa, Artificial Sequence
  Description of Artificial Sequence: Synthetic polypeptide
QVQLLESGGDVVQPGTSLRLSCAASGFSLWTSGMHWVRQAPGKGLEWVAVMSYDETKKYYADSVRGRFSISRDNSRNTLYLQMNSLRVEDTAVYFCAKPRLDYLDYFHAADSWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4744 - protein, 451 aa, Artificial Sequence
  Description of Artificial Sequence: Synthetic polypeptide
QVQLVQSGGDLVQPGGSLRLSCAASGFTFSRYSMNWVRQAPGMGLEWVAYISDTSRTIYYADSVKGRFTISRDNAKNSLYLQMKSLRDEDTAVYYCARDPDTPFVRAFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 4745 - protein, 215 aa, Artificial Sequence
  Description of Artificial Sequence: Synthetic polypeptide
DITLTQSPATLSVSPGERATLSCRASQSVSSNLAWYQQKPGQAPRLLIYGASNRATDIPARFSGSGSGTEFTLTISSLQSEDFAVYYCQQFNDWPFLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4746 - protein, 215 aa, Artificial Sequence; identical to SEQ ID NO: 4230
  Description of Artificial Sequence: Synthetic polypeptide

SEQ ID NO: 4747 - protein, 217 aa, Artificial Sequence; identical to SEQ ID NO: 4226
  Description of Artificial Sequence: Synthetic polypeptide

SEQ ID NO: 4748 - protein, 214 aa, Artificial Sequence
  Description of Artificial Sequence: Synthetic polypeptide
DIVLTQSPATLSVSPGERATLSCRASQSVNRNLAWFQQIPGQAPRLLIFDASTRAADIPARFSGGGSGAEFTLTVSSLQPEDFAVYYCQQYDKWPPGFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4749 - protein, 219 aa, Artificial Sequence; identical to SEQ ID NO: 4731
  Description of Artificial Sequence: Synthetic polypeptide

SEQ ID NO: 4750 - protein, 219 aa, Artificial Sequence
  Description of Artificial Sequence: Synthetic polypeptide
DIEMTQSPLSLPVTPGEPASISCRSSQSLLHSNGYNHLAWYLQKPGRSPHLLIYLASTRASGVPDRFSGSGSGTDFTLKISRVEAEDVGIYYCMQSLQTSITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4751 - protein, 214 aa, Artificial Sequence
  Description of Artificial Sequence: Synthetic polypeptide
DIVLTQSPSVSVAPGQTARITCGGNDIGSKSVHWYQQKPGQAPVLVVFDDRDRPSGIPERFSGSNSGNTATLTISRVEAGDEADYYCQVWDITSDLVVFGGGTKLTVVGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVVPAECS

SEQ ID NO: 4752 - protein, 215 aa, Artificial Sequence
  Description of Artificial Sequence: Synthetic polypeptide
DIVMTQPPGTLSVSPGERATLSCRASQSVSTNLAWYQQKPGQAPRLLIHGASTRATGIPARFSGSGSGAEFTLTISSLQSEDVAVYYCQQYDNWLPITFGPGTKVDIQRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4753 - protein, 112 aa, Artificial Sequence
  Description of Artificial Sequence: Synthetic polypeptide
EVQLVESGGGLVQPGGSLRLSCAASGFTVSTYAMSWVRQTPEKRLEWVASMSSGGSLYYPDTVKGRFTISRDNSKNTVYLQMNSLRAEDTAMYYCVRGGYGTSYWGQGTLVT

SEQ ID NO: 4754 - protein, 112 aa, Artificial Sequence
  Description of Artificial Sequence: Synthetic polypeptide
DIVMTQTPLSLSVTPGEPASISCRSSQSIVHSIGDTYLEWYLQKPGQSPQLLIYKVSNRFSGVPDRFSGSGSGTDFTLKISRVEAEDVGVYYCFQGSHFPYTFGQGTKLEIK

SEQ ID NO: 4755 - protein, 112 aa, Artificial Sequence
  Description of Artificial Sequence: Synthetic polypeptide
DIVMTQTPLSLSVTPGEPASISCRSSQSIVHSIGDTYLEWYLQKPGQSPKLLIYKVSNRFSGVPDRFSGSGSGTDFTLKISRVEAEDVGVYYCFQGSHFPYTFGQGTKLEIK

SEQ ID NO: 4756 - protein, 112 aa, Artificial Sequence
  Description of Artificial Sequence: Synthetic polypeptide
DIVMTQTPLSLSVTPGEPASISCRSSQSIVHSIGDTYLEWYLQKPGQSPQLLIYKVSNRFSGVPDRFSGSGSGTDFTLKISRVEAEDVGIYYCFQGSHFPYTFGQGTKLEIK

SEQ ID NO: 4757 - protein, 112 aa, Artificial Sequence; identical to SEQ ID NO: 4754
  Description of Artificial Sequence: Synthetic polypeptide

SEQ ID NO: 4758 - protein, 112 aa, Artificial Sequence; identical to SEQ ID NO: 4755
  Description of Artificial Sequence: Synthetic polypeptide

SEQ ID NO: 4759 - protein, 112 aa, Artificial Sequence; identical to SEQ ID NO: 4756
  Description of Artificial Sequence: Synthetic polypeptide

SEQ ID NO: 4760 - protein, 112 aa, Artificial Sequence; identical to SEQ ID NO: 4754
  Description of Artificial Sequence: Synthetic polypeptide

SEQ ID NO: 4761 - protein, 112 aa, Artificial Sequence; identical to SEQ ID NO: 4755
  Description of Artificial Sequence: Synthetic polypeptide

SEQ ID NO: 4762 - protein, 112 aa, Artificial Sequence
  Description of Artificial Sequence: Synthetic polypeptide
ELLLTQTPLSLPVSLGDQASISCRSSQSIVHSIGDTYLEWYLQKPGQSPKLLIYKVSNRFSGVPDRFSGSGSGTDFTLKISRVEAEDLGIYYCFQGSHFPYTFGGGTKLEIK

SEQ ID NO: 4763 - protein, 107 aa, Artificial Sequence
  Description of Artificial Sequence: Synthetic polypeptide
DIQMTQSPSSLSASVGDRVTITCRASQSISTYLNWYQQKPGIPPKLLINVASSLQSGVPSRFSGSGSGTDFTLTISSLQPEDFASYYCQQTYSSPPTFGQGTKVEIK

SEQ ID NO: 4764 - protein, 111 aa, Artificial Sequence
  Description of Artificial Sequence: Synthetic polypeptide
QSVLTQPPSASGTPGQRVTISCSGSTSNIGSNAVNWYQQLPGTAPKLLIYSNNQRPSGVPDRFSGSKSGTSASLAISGLQSEDEADYYCAAWDDSLSGSWVFGGGTKLTVL

SEQ ID NO: 4765 - protein, 106 aa, Artificial Sequence
  Description of Artificial Sequence: Synthetic polypeptide
EIVMTQSPDTLSVSPGERATLSCRASQSVNRRLAWYQQKPGQAPRLLIHDASTRATGIPARFSGSGSGTEFTLTISSLQSEDFAVYYCQQYDNWLSFGQGTRLEIK

SEQ ID NO: 4766 - protein, 107 aa, Artificial Sequence
  Description of Artificial Sequence: Synthetic polypeptide
DIQMTQSPSTLSGSVGDRVTITCRASQNIGPWLAWYQQESGKAPKLLISRASILESGVPSRFSGTGTGTEFTLTISSLQPDDFATYYCQHYNAYWGTFGQGTKVEIN

SEQ ID NO: 4767 - protein, 108 aa, Artificial Sequence
  Description of Artificial Sequence: Synthetic polypeptide
DIQLTQSPSSLSASVGDRVTITCRASQGIITYLNWYQQKPGKAPKLLIYATYSLQNGVPSRFSGSGSGTDFTLTISSLQPEDFATYYCQQSYSSLMFTFGQGTKLDIK

SEQ ID NO: 4768 - protein, 107 aa, Artificial Sequence
  Description of Artificial Sequence: Synthetic polypeptide
VIWMTQSPSLLSASTGDRVTISCRMSQGISSYLAWYQQKPGKAPELLIHTAYTLKSGVPSRFSGSGSGKDFTLTISGLQSEDFATYYCQQYYSFPYTFGQGTKVEIK

SEQ ID NO: 4769 - protein, 112 aa, Artificial Sequence
  Description of Artificial Sequence: Synthetic polypeptide
DIVMTQSPLSLPVTPGEPASISCRASQSLLHSNGYNYLDWYLQKPGQSPQLLIQLGSTRASGVPDRFSGSGSGTDFTLEISRVEAEDVGVYYCMQALQLPLAFGQGTRLEIK

SEQ ID NO: 4770 - protein, 107 aa, Artificial Sequence
  Description of Artificial Sequence: Synthetic polypeptide
DIQMTQSPSSVSASVGDRVTITCRASQDVSTWLAWYQLKPGKAPKLLIYAASSLQSGVPSRFSGSGSGTDFTLTVSSLQPEDFATYYCQQANSFPFTFGPGTKVDIK

SEQ ID NO: 4771 - protein, 110 aa, Artificial Sequence
  Description of Artificial Sequence: Synthetic polypeptide
QSVLTQPPSVSAAPGQRVTISCSGTSSNIGKNYVSWYQQLPGAAPKLLIYDNDKRPSGIPDRFSGSKSGTSATLGITGLQTGDEADYYCGTWDSSLSVGMFGGGTRLTVL

SEQ ID NO: 4772 - protein, 107 aa, Artificial Sequence
  Description of Artificial Sequence: Synthetic polypeptide
DIQLTQSPSFLSASVGDGVTITCRASQDIYIYLAWYQQKPGKAPKLLIYAASTLQGGVPSRFSGSGSGTEFTLTINNLQPEDFATYFCQQLNGYPLTFGGGTKVEIK

SEQ ID NO: 4773 - protein, 112 aa, Artificial Sequence
  Description of Artificial Sequence: Synthetic polypeptide
DIVMTQSPLSLPVSPGEPASISCRSSQSLLHGNGYNYLDWYLQKPGQSPRLLIYLGSNRASGVPDRFSGSGSGTDFTLKISRVEAEDVGVYYCMQALQTPLTFGGGTKVEIK

SEQ ID NO: 4774 - protein, 216 aa, Artificial Sequence
  Description of Artificial Sequence: Synthetic polypeptide
EIVLTQSPATLSVSPGERATLSCRASQSVSHNLAWYQQKPGQAPRLLVYSASTRATGIPARFSGSGSGTEFTLAISSLQSEDFAVYYCQHYTNYPPRLTFGGGSKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4775 - protein, 216 aa, Artificial Sequence
  Description of Artificial Sequence: Synthetic polypeptide
DIVMTQSPSTLSASVGDRVTITCRASQSIGNWLAWYQQKPGKAPKLLIYKVSTLESGVPSRFSGSGSGTEFTLTINSLQPDDFATYYCQRYTSNSQGFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4776 - protein, 216 aa, Artificial Sequence
  Description of Artificial Sequence: Synthetic polypeptide
DIQLTQSPLSPPVTLGQPASISCRSSQSLLYTDGFTYLSWYHQRPGQSPRRLIYKISNRDSGVPDRFSGSGSGTDFTLKISRVEAEDVGVYYCMQATHWPLTFGEGTKVEIKPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 4777 - protein, 234 aa, Artificial Sequence; identical to SEQ ID NO: 4654
  Description of Artificial Sequence: Synthetic polypeptide

SEQ ID NO: 4778 - protein, 214 aa, Artificial Sequence
  Description of Artificial Sequence: Synthetic polypeptide
DIQLTQSPSSLSASVGDRVTLTCQASQDIRKFLNWYQQKPGKGPKLLIYDASNLQRGVPSRFSGGGSGTDFTLIISSLQPEDVGTYYCQQYDGLPFTFGGGTKVVIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4779 - protein, 216 aa, Artificial Sequence
  Description of Artificial Sequence: Synthetic polypeptide
QEIVMTQSPGTLSLSPGERATLSCRASQSVSMNYLAWFQQKPGQAPRLLIYGASRRATGIPDRISGSGSGTDFTLTISRLEPADFAVYYCQQYGTSPRTFGQGAKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4780 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4781 - protein, 220 aa, Artificial Sequence
  Description of Artificial Sequence: Synthetic polypeptide
DIQMTQSPDSLAVSLGERATINCKSSQSVFSSSTNKNYLAWYQQKPGQPPKVLIYWSSTRESGVPDRFSASGSGTDFTLTISSLQAADVAVYYCHQYYTAPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4782 - protein, 216 aa, Artificial Sequence
  Description of Artificial Sequence: Synthetic polypeptide
QSVLTQPPSASGTPGQRVTISCSGSSSNIGTNYVYWYQQFPGTAPKLLIYRSYQRPSGVPDRFSGSKSGSSASLAISGLQSEDEADYYCATWDDSLNGWVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4783 - protein, 216 aa, Artificial Sequence
  Description of Artificial Sequence: Synthetic polypeptide
QSVLTQPPSASGTPGQRVTISCSGSSSNIGTNYVYWYQQFPGTAPKLLIYRSYQRPSGVPDRFSGSKSGSSASLAISGLQSEDEADYYCATWDDSLDGWVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4784 - protein, 216 aa, Artificial Sequence
  Description of Artificial Sequence: Synthetic polypeptide
QSALTQPPAVSGTPGQRVTISCSGSDSNIGRRSVNWYQQFPGTAPKLLIYSNDQRPSVVPDRFSGSKSGTSASLAISGLQSEDEAEYYCAAWDDSLKGAVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4785 - protein, 214 aa, Artificial Sequence
  Description of Artificial Sequence: Synthetic polypeptide
QSALTQPPSVSVAPGQTATITCGGNNIGRKRVDWFQQKPGQAPVLVVYEDSDRPSGIPERFSDSNSGTTATLTISRVEAGDEADYYCQVWDSDSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4786 - protein, 217 aa, Artificial Sequence
  Description of Artificial Sequence: Synthetic polypeptide
DIVMTQSPSSLTVTAGEKVTMSCKSSQSLFNSGKRKNFLTWYHQKPGQPPKLLIYWASTRESGVPDRFSGSGSGTDFTLTITSVQAEDLAIYYCQNDYSHPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNR

SEQ ID NO: 4787 - protein, 214 aa, Artificial Sequence
  Description of Artificial Sequence: Synthetic polypeptide
ELQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4788 - protein, 214 aa, Artificial Sequence
  Description of Artificial Sequence: Synthetic polypeptide
DIQLTQSPSSLSASVGDRVTITCQASQDIRKYLNWYQQKPGKAPNLLIYDASNVKTGVPSRFRGSGSGTDFTFTISSLQPEDIATYYCQQYDNLPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4789 - protein, 215 aa, Artificial Sequence
  Description of Artificial Sequence: Synthetic polypeptide
DIQLTQSPASLSVSPGERATLSCRASQSVAGNLAWYQQKPGQAPRLLIYGASTRATGIPARFSGSGSGTEFTLTITSLQSEDFAVYYCQQYNNWPPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4790 - protein, 218 aa, Artificial Sequence
  Description of Artificial Sequence: Synthetic polypeptide
QSVLTQSPSASGTPGQAITISCSGSSSNIGSNPVNWYQQLPGAAPKLLIYADEHRPSGVPDRFSGSKSGTSASLAISGLQSEDEADYYCAAWDDSLSGPAVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4791 - protein, 217 aa, Artificial Sequence; identical to SEQ ID NO: 4661
  Description of Artificial Sequence: Synthetic polypeptide

SEQ ID NO: 4792 - protein, 218 aa, Artificial Sequence
  Description of Artificial Sequence: Synthetic polypeptide
DIVMTQSPDSLAVSLGERATINCKSSQSVTFNYKNYLAWYQQKPGQPPKLLIYWASTRESGVPDRFSGSGSGTDFTLTISSLQAEDVAVYYCQQHYRTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4793 - protein, 220 aa, Artificial Sequence
  Description of Artificial Sequence: Synthetic polypeptide
QSVLTQPPSVSGAPGQRVTISCTGSSSNIGAGYAVHWYQQLPGTAPKLLISGNSNRPSGVPDRFSGSKSGTSASLAITGLQAEDEADYYCQSYDSSLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSARQ

SEQ ID NO: 4794 - protein, 105 aa, Artificial Sequence
  Description of Artificial Sequence: Synthetic polypeptide
ELTQSPSSVSASVGDRVTITCRATQGISSWLAWYQQKPGKPPKLLIFGASSLQSGVPSRFSGSGSGTDFTLTISSLQPEDFATYFCQQAHSFPLTFGGGTKVEIK

SEQ ID NO: 4795 - protein, 105 aa, Artificial Sequence
  Description of Artificial Sequence: Synthetic polypeptide
ELTQSPSSLSASVGDSVTITCRTSERISTYLNWYQQKPGKAPRLLVSGASTLQGGVPSRFSGSGSGTAFTLTINSLQPEDFATYYCQQSYSTPLTFGGGTKVEIK

SEQ ID NO: 4796 - protein, 214 aa, Artificial Sequence
  Description of Artificial Sequence: Synthetic polypeptide
SYVLTQPPSVSVAPGETARISCGGNNIGTKVLHWYQQTPGQAPVLVVYDDSDRPSGIPERFSGSNSGNTATLTISRVEVGDEADYYCQVWDISTDQAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4797 - protein, 11 aa, Artificial Sequence
  Description of Artificial Sequence: Synthetic peptide
KASQNVGSNVA

SEQ ID NO: 4798 - protein, 7 aa, Artificial Sequence
  Description of Artificial Sequence: Synthetic peptide
SASHRYS

SEQ ID NO: 4799 - protein, 9 aa, Artificial Sequence
  Description of Artificial Sequence: Synthetic peptide
QQYYSYPYT

SEQ ID NO: 4800 - protein, 215 aa, Artificial Sequence
  Description of Artificial Sequence: Synthetic polypeptide
EIVLTQSPGTLSVSPGERATLSCRASRRVGSTYLAWYQQKPGQAPRRLIYGASSRAAGIPDRFSGTGSGTDFTLTISRVDPEDFAVYYCQQYAASPWTFGQGTTVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4801 - protein, 215 aa, Artificial Sequence
  Description of Artificial Sequence: Synthetic polypeptide
EVVLTQSPGTLTLPPGDRATLSCRASHSVGSTYIAWFQQKSGQAPRRLIYGASNRATDIPDRFSGSGSGTDFTLTIRRLEPEDSAVYYCQQFSVSPWTFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4802 - protein, 215 aa, Artificial Sequence
  Description of Artificial Sequence: Synthetic polypeptide
EVVLTQSPGTLALPPGERATLSCRASHSIGSTYIAWYQQKSGQAPRRLIYGASNRASDIPDRFSGSGSGTDFTLTIRRLEPEDSAVYYCQQFSVSPWTFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4803 - protein, 215 aa, Artificial Sequence
  Description of Artificial Sequence: Synthetic polypeptide
IVLTQSPATLSVSPGERATLSCRASQVISHNLAWYQQKPGQAPRLLIYGASTRASGIPARFSGSGSGTDYTLTITSLQPEDFAVYYCQHYSNWPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4804 - protein, 234 aa, Artificial Sequence
  Description of Artificial Sequence: Synthetic polypeptide
MRVPAQLLGLLLLWLPGARCDIQMTQSPSSLSASVGDRVTITCRASENIYSYLAWYQQKPGKAPKLLVYFAKTLAEGVPSRFSGSGSGTEFTLTISSLQPDDFANYYCQHHYGTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4805 - protein, 234 aa, Artificial Sequence
  Description of Artificial Sequence: Synthetic polypeptide
MRVPAQLLGLLLLWLPGARCDIQMTQSPSSLSASVGDRVTITCRASENIYSYLAWYQQKPGKAPKLLVYFAKTLAEGVPSRFSGSGSGTEFTLTISSLQPDDFATYYCQHHYGTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4806 - protein, 236 aa, Artificial Sequence
  Description of Artificial Sequence: Synthetic polypeptide
MAWMMLLLTLLAHCTGSWAQSVLTQPPSLSGAPGQRVTISCTGSSSNIGADYDVYWYQHLPGTAPKLLMYGDGYRPSGVPDRFSGSKSGTSASLAITGLQAEDEADYYCQSYDSSLSRRVVFGGGTKLTVLGQPKAAPSVLFPPSSEELQANKATLMCLISDFYPGAVTVAWKADSSPVKAGVETTTPSKQSNNKYAASSYLSLTPEQWKSHRSYSCQVTHEGSTVEKTVAPTECS

SEQ ID NO: 4807 - protein, 113 aa, Artificial Sequence
  Description of Artificial Sequence: Synthetic polypeptide
EIVMTQSPDSLAVSLGERATINCKSSQSVTYNYKNYLAWYQQKPGQPPKLLIYWASTRESGVPDRFSGSGSGTDFTLTISSLQAEDVAVYYCQQYYRTPPTFGGGTKLDIKGS

SEQ ID NO: 4808 - protein, 109 aa, Artificial Sequence
  Description of Artificial Sequence: Synthetic polypeptide
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGS

SEQ ID NO: 4809 - protein, 113 aa, Artificial Sequence
  Description of Artificial Sequence: Synthetic polypeptide
DIQMTQSPSSLSASVGDRVTITCRASQDIPRSISGYVAWYQQKPGKAPKLLIYWGSYLYSGVPSRFSGSRSGTDFTLTISSLQPEDFATYYCQQHYTTPPTFGQGTKVEIKGS

SEQ ID NO: 4810 - protein, 113 aa, Artificial Sequence
  Description of Artificial Sequence: Synthetic polypeptide
DIQMTQSPSSLSASVGDRVTITCRASQDIPFSYKGYVAWYQQKPGKAPKLLIYWGSYLESGVPSRFSGSGSGTDFTLTISSLQPEDFATYYCQQHYTTPPTFGQGTKVEIKGS

SEQ ID NO: 4811 - protein, 112 aa, Artificial Sequence
  Description of Artificial Sequence: Synthetic polypeptide
DIQMTQSPSSLSASVGDRVTITCRASQSITFDYKNYVAWYQQKPGKAPKLLIYWGSYLEGVPSRFSGSGSGTDFTLTISSLQPEDFATYYCQQHYTTPPTFGQGTKVEIKGS

SEQ ID NO: 4812 - protein, 113 aa, Artificial Sequence
  Description of Artificial Sequence: Synthetic polypeptide
DIQMTQSPSSLSASVGDRVTITCRASQSITFNYKNYVAWYQQKPGKAPKLLIYWGSYLESGVPSRFSGSGSGTDFTLTISSLQPEDFATYYCQQHYTTPPTFGQGTKVEIKGS

SEQ ID NO: 4813 - protein, 113 aa, Artificial Sequence
  Description of Artificial Sequence: Synthetic polypeptide
DIQMTQSPSSLSASVGDRVTITCRASQSITFSYKNYVAWYQQKPGKAPKLLIYWGSYLESGVPSRFSGSGSGTDFTLTISSLQPEDFATYYCQQHYTTPPTFGQGTKVEIKGS

SEQ ID NO: 4814 - protein, 113 aa, Artificial Sequence
  Description of Artificial Sequence: Synthetic polypeptide
DIQMTQSPSSLSASVGDRVTITCRASQDIPFSYKGYVAWYQQKPGKAPKVLIYWGSYLESGVPSRFSGSGSGTDFTLTISSLQPEDFATYYCQQHYTTPPTFGQGTKVEIKGS

SEQ ID NO: 4815 - protein, 113 aa, Artificial Sequence
  Description of Artificial Sequence: Synthetic polypeptide
DIQMTQSPSSLSASVGDRVTITCRASQSITFDYKNYVAWYQQKPGKAPKVLIYWGSYLESGVPSRFSGSGSGTDFTLTISSLQPEDFATYYCQQHYTTPPTFGQGTKVEIKGS

SEQ ID NO: 4816 - protein, 113 aa, Artificial Sequence
  Description of Artificial Sequence: Synthetic polypeptide
DIQMTQSPSSLSASVGDRVTITCRASQSITFNYKNYVAWYQQKPGKAPKVLIYWGSYLESGVPSRFSGSGSGTDFTLTISSLQPEDFATYYCQQHYTTPPTFGQGTKVEIKGS

SEQ ID NO: 4817 - protein, 113 aa, Artificial Sequence
  Description of Artificial Sequence: Synthetic polypeptide
DIQMTQSPSSLSASVGDRVTITCRASQSITFSYKNYVAWYQQKPGKAPKVLIYWGSYLESGVPSRFSGSGSGTDFTLTISSLQPEDFATYYCQQHYTTPPTFGQGTKVEIKGS

SEQ ID NO: 4818 - protein, 109 aa, Artificial Sequence
  Description of Artificial Sequence: Synthetic polypeptide
EIVLTQSPATLSVSPGERVTLSCRASQSVANNLAWYQQKPGQSPRLLIYGASTRDTGIPARFSGSGSGTEFTLTISSLQSEDFAVYYCQQYNNWPPMYTFGQGTKLEIK

SEQ ID NO: 4819 - protein, 107 aa, Artificial Sequence
  Description of Artificial Sequence: Synthetic polypeptide
DIQMTQSPSSLSASLGERVSLTCRASQEISGYLSWLQQKPDGTIKRLIYAASTLDSGVPKRFSGSRSGSDYSLSISSLESEDFADYYCLQYANYPWSFGGGTKLEIK

SEQ ID NO: 4820 - protein, 124 aa, Artificial Sequence
  Description of Artificial Sequence: Synthetic polypeptide
MTCSPLLLTLLIHCTGSWAQSVLTQPPSMSAPGQKVTISCSGSSSNIGYISWYQQLPGTAPLIYDNNKRPSGIPDRFSGSKSGTSATLGITGLQTGDEAYYCGSWDSSLSAGVFGTGTKVTVLG

SEQ ID NO: 4821 - protein, 129 aa, Artificial Sequence
  Description of Artificial Sequence: Synthetic polypeptide
MAWTPLFLFLLTCCPGSNSQTVVTQEPSLTVSPRGTVTLTCSSSTGAVTSGYYPGWFQLKPGQAPMSLIYSARKKHSWTPARFSGSLLGGKAALTLSGVQPEDEAEYYCLLYYGGAYVFGTGTKVTVLG

SEQ ID NO: 4822 - protein, 128 aa, Artificial Sequence
  Description of Artificial Sequence: Synthetic polypeptide
MRVLAQLLGLLLLCFPGARCDIQMTQSPSSLSASVGDRVTITCRASQGISSWLAWYQQKPEKVPKSLIYAASSLQSGVPSRFSGSGSGTDFTLTISSLQPEDFATYYCQQYNYYPLTFGGGTKVEIKR

SEQ ID NO: 4823 - protein, 113 aa, Artificial Sequence
  Description of Artificial Sequence: Synthetic polypeptide
DIVMSQSPSSLAVSVGEKVSMTCKSSQRLLYSSDQKNYLAWYQQKPGQSPKVLIYWASTRVSGVPDRFTGSESGTDFTLTISSVKAEDLAVYYCQQYYTYPLTFGAGTKLELK

SEQ ID NO: 4824 - protein, 113 aa, Artificial Sequence
  Description of Artificial Sequence: Synthetic polypeptide
DIVMTQSPDSLAVSLGERATMNCKSSQRLLYSSDQKNYLAWYQQKPGQPPKVLIYWASTRVSGVPDRFSGSESGTDFTLTISSLQAEDVAVYYCQQYYTYPLTFGQGTKVEIK

SEQ ID NO: 4825 - protein, 107 aa, Artificial Sequence
  Description of Artificial Sequence: Synthetic polypeptide
DIQMTQSPSSFSVSLGDRVTITCKASEDIYNRLAWYQQKPGNAPRLLISDTTNLWIGVPSRFSGSGSGKDYTLSITSLQSEDVATYYCQQYWSSRTFGGGTKLEIKR

SEQ ID NO: 4826 - protein, 107 aa, Artificial Sequence
  Description of Artificial Sequence: Synthetic polypeptide
DIQMTQSPSSFSVSLGDRVTITCKASEDIYNRVAWYQQKPGNAPRLLMSDATSLGAGVPSRFSGSGSGKDHTLSITSLQTEDVATYYCQQYWNTRTFGGGTKLEIKR

SEQ ID NO: 4827 - protein, 111 aa, Artificial Sequence
  Description of Artificial Sequence: Synthetic polypeptide
DIQMTQSPDSLAVSLGARATINCKSSQSVTFNYKNYLAWYQQKPGQPPKVLIYWASARESGVPDRFSGSGSGTDFTLTISSLQAEDVAVYYCQQHYRTPPTFGQGTKVEIK

SEQ ID NO: 4828 - protein, 111 aa, Artificial Sequence
  Description of Artificial Sequence: Synthetic polypeptide
DIVMTQSPDSLAVSLGERATINCKSSQSVTFNYKNYLAWYQQKPGQPPKLLIYWASTRESGVPDRFSGSGSGTDFTLTISSLQAEDVAVYYCQQHYRTPPTFGQGTKVEIK

SEQ ID NO: 4829 - protein, 111 aa, Artificial Sequence
  Description of Artificial Sequence: Synthetic polypeptide
DIVMTQSPDSLAVSLGERATINCKSSQSVTFNNKNYLAWYQQKPGQPPKLLIYWASTRESGVPDRFSGSGSGTDFTLTISSLQAEDVAVYYCQQHYRTPPTFGQGTKVEIK

SEQ ID NO: 4830 - protein, 112 aa, Artificial Sequence
  Description of Artificial Sequence: Synthetic polypeptide
DIVMTQSPDSLAVSLGERATINCKSSQSVLYSSNNKNYLAWYQQKPGQPPKLLIDWASTRESGVPDRFSGSGSGTDFTLTISNLQVEDVAVYYCQQYYRSPSFGQGTKLEIK

SEQ ID NO: 4831 - protein, 107 aa, Artificial Sequence
  Description of Artificial Sequence: Synthetic polypeptide
DIQMTQSPSSLSASVGDRVTITCRASQNIYKYLNWYQQRPGKAPKGLISAASGLQSGVPSRFSGSGSGTDFTLTITSLQPEDFATYYCQQSYSPPLTFGGGTRVEIK

SEQ ID NO: 4832 - protein, 107 aa, Artificial Sequence
  Description of Artificial Sequence: Synthetic polypeptide
DIQMTQSPSSLSSSVGDRVTITCRASQSIGAYVNWYQQKAGKAPQVLIFGASNLQSGVPSRFSGSGSGTDFTLTISSLQPEDFATYFCQQTYSTPITFGQGTRLEIK

SEQ ID NO: 4833 - protein, 107 aa, Artificial Sequence
  Description of Artificial Sequence: Synthetic polypeptide
DIQMTQSPSSLSASVGDRVTISCRASQSISTYLNWYQQQPGKAPKVLIFGATNLQSGVPSRFSGSGSGTDFTLTISSLQPEDFATYYCQQSYNTPLIFGQGTKLEIK

SEQ ID NO: 4834 - protein, 107 aa, Artificial Sequence
  Description of Artificial Sequence: Synthetic polypeptide
DIQMTQSPSSLSASVGDRVTISCRASQSISTYLNWYQQQPGKAPKVLISGATNLQSGVPSRFSGSGSGTDFTLTISSLQPEDFATYYCQQSYNTPLIFGQGTKLEIK

SEQ ID NO: 4835 - protein, 106 aa, Artificial Sequence
  Description of Artificial Sequence: Synthetic polypeptide
DIQMTQSPLSVSVSVGDRVTIACRASQSIDKFLNWYQQKPGKAPKLLIYGASNLHSGAPSRFSASGSGTDFTLTITNIQTEDFATYLCQQSFSVPAFGGGTKVEIK

SEQ ID NO: 4836 - protein, 106 aa, Artificial Sequence
  Description of Artificial Sequence: Synthetic polypeptide
DIQMTQSPSSLSASVGDRVTITCRASQSISTYLNWYQKRPGKAPKLLVYGASTLQSGVPSRFSGSGSGTDFTLTIASLQPEDSATYYCQQTYSIPLFGQGTRLEIK

SEQ ID NO: 4837 - protein, 106 aa, Artificial Sequence
  Description of Artificial Sequence: Synthetic polypeptide
DIQMTQSPSSLSASVGDRVTITCRASQSISTYLNWYQKRPGKAPKLLVYGASSLQSGVPSRFSGSGSGTDFTLTIASLQPEDSAVYYCQQTYSIPLFGQGTRLEIK

SEQ ID NO: 4838 - protein, 107 aa, Artificial Sequence
  Description of Artificial Sequence: Synthetic polypeptide
DIQMTQSPSSLSASVGDRLTITCRASQSISTYLHWYQQKPGKAPKLLIYAASSLQSGVPSRFSGSRSGTDFTLTISSLQPDDFATYYCQQSYSPPLTFGPGTKVDMK

SEQ ID NO: 4839 - protein, 107 aa, Artificial Sequence
  Description of Artificial Sequence: Synthetic polypeptide
DIQMTQSPSSLSASVGDRVTITCRASQSISNYLNWYQHKPGEAPKLLNYAASSLQSGVPSRFSASGSGTDFTLTISSLQPEDFATYYCQQSYNTPITFGQGTRLEIK

SEQ ID NO: 4840 - protein, 107 aa, Artificial Sequence
  Description of Artificial Sequence: Synthetic polypeptide
DIQMTQSPSSLSASVGDRVTITCRASQSISNYLNWYQHKPGEAPKLLNYAASSLQSGVPSRFSASGSGTDFTLSISGLQPEDFATYYCQQSYNTPITFGPGTRLEIK

SEQ ID NO: 4841 - protein, 107 aa, Artificial Sequence
  Description of Artificial Sequence: Synthetic polypeptide
DIQMTQSPSSLSASVGDRVTITCRASQSISTYLNWYQQKPGKAPKLLIYAASSLHSGVPSRFSGSGSGTDFALTISSLQPEDFATYYCQQSYSPPITFGQGTRLEIK

SEQ ID NO: 4842 - protein, 120 aa, Artificial Sequence; identical to SEQ ID NO: 4596
  Description of Artificial Sequence: Synthetic polypeptide

SEQ ID NO: 4843 - protein, 121 aa, Artificial Sequence; identical to SEQ ID NO: 4358
  Description of Artificial Sequence: Synthetic polypeptide

SEQ ID NO: 4844 - protein, 118 aa, Artificial Sequence; identical to SEQ ID NO: 4373
  Description of Artificial Sequence: Synthetic polypeptide

SEQ ID NO: 4845 - protein, 107 aa, Artificial Sequence
  Description of Artificial Sequence: Synthetic polypeptide
DIQMTQSPSSLSASVGDRVTITCRASQSISRYLNWYQQEPGKAPKLLVYAASSLQSGVPSRFSGSGSGTDFTLTISSLQPEDFATYYCQQSYSTPLTFGQGTRLEIK

SEQ ID NO: 4846 - protein, 106 aa, Artificial Sequence; identical to SEQ ID NO: 4371
  Description of Artificial Sequence: Synthetic polypeptide

SEQ ID NO: 4847 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISRLEPEDFAVYFCQQYGSSPQFGQGTRLEIK

SEQ ID NO: 4848 - protein, 17 aa, Artificial Sequence
  Description of Artificial Sequence: Synthetic peptide
NFMLTQPHSVSASPGKT

SEQ ID NO: 4849 - protein, 110 aa, Artificial Sequence
  Description of Artificial Sequence: Synthetic polypeptide
QSVLTQPPSASGSPGQSVTISCTGTSSDVGGYNSVSWYQQHPGKAPKLMIYEVTKRPSGVPDRFSASKSGNTASLTVSGLQAEDEADYFCCSYAGHSAYVFGTGTKVTVL

SEQ ID NO: 4850 - protein, 108 aa, Artificial Sequence
  Description of Artificial Sequence: Synthetic polypeptide
EIVLTQSPGTLSLSPGERATLSCRASQSLSSKYLAWYQQKPGQAPRLLIYGASSRATGIPDRFSGSGSGTDFTLTISRLEPEDFAVYSCQQYDGVPRTFGQGTTVEIK

SEQ ID NO: 4851 - protein, 110 aa, Artificial Sequence
  Description of Artificial Sequence: Synthetic polypeptide
LPVLTQPPSASGTPGQRVTISCSGSSSNIGSNTVNWYQQLPGTAPKLLIYSNNQRPSGVPDRFSGSRSGTSASLAIIGLRPEDEADYYCQSYDSRLSASLFGTGTTVTVL

SEQ ID NO: 4852 - protein, 107 aa, Artificial Sequence
  Description of Artificial Sequence: Synthetic polypeptide
DIQMTQSPSSLSASVGDRVTITCRASQSISSYLNWYQQKPGKAPKLLIYAASSLQRGVPSRFSGSGSGTDFTLTISSLQPEDFAVYYCQQYDSSPYTFGQGTKVEIK

SEQ ID NO: 4853 - protein, 110 aa, Artificial Sequence
  Description of Artificial Sequence: Synthetic polypeptide
QPGLTQPPSVSKGLRQTATLTCTGNSNNVGNQGAAWLQQHQGHPPKLLSYRNNDRPSGISERFSASRSGNTASLTITGLQPEDEADYYCSTWDSSLSAVVFGGGTKLTVL

SEQ ID NO: 4854 - protein, 110 aa, Artificial Sequence
  Description of Artificial Sequence: Synthetic polypeptide
SYELTQPPSVSKGLRQTAILTCTGDSNNVGHQGTAWLQQHQGHPPKLLSYRNGNRPSGISERFSASRSGNTASLTIIGLQPEDEADYYCSVWDSSLSAWVFGGGTKLTVL

SEQ ID NO: 4855 - protein, 108 aa, Artificial Sequence
  Description of Artificial Sequence: Synthetic polypeptide
QPVLTQPPSVSVAPGQTASIPCGGNNIGGYSVHWYQQKPGQAPLLVIYDDKDRPSGIPERFSGANSGSTATLTISRVEAGDEGDYYCQVWDSGNDRPLFGGGTKLTVL

SEQ ID NO: 4856 - protein, 110 aa, Artificial Sequence
  Description of Artificial Sequence: Synthetic polypeptide
SYELTQPPSASGKHGQRVTISCSGGTSNIGRNHVNWYQQLPGTAPKLLIYSNEQRPSGVPDRFSGSKSGTSASLAVSGLQSEDEADYYCASWDDNLSGWVFGGGTKLTVL

SEQ ID NO: 4857 - protein, 126 aa, Artificial Sequence
  Description of Artificial Sequence: Synthetic polypeptide
EVQLVQSGAEVKKPGASVKVSCKASGYTFTDYHINWVRQAPGQGLEWMGWIHPNSGDTNYAQKFQGWVTMTRDTAISTAYMEVNGLKSDDTAVYYCARGGLEPRSVDYYYYGMDVWGQGTTVTVSS

SEQ ID NO: 4858 - protein, 126 aa, Artificial Sequence
  Description of Artificial Sequence: Synthetic polypeptide
QVQLVQSGAEVKKPGASVKVSCKASGYTFTDYHINWVRQAPGQGLEWMGWIHPNSGDTNYAQKFQGWVTMTRDTSISTAYMEVNGLKSDDTAVYYCARGGLEPRSVDYYYYGMDVWGQGTTVTVSS

SEQ ID NO: 4859 - protein, 126 aa, Artificial Sequence
  Description of Artificial Sequence: Synthetic polypeptide
QVQLVQSGAEVRKPGASVKVSCKASGYTFTDNYIHWVRQAPGQGLEWMGWIHPNSGATKYAQKFEGWVTMTRDTSISTVYMELSRSRSDDTAVYYCARAGLEPRSVDYYFYGLDVWGQGTAVTVSS

SEQ ID NO: 4860 - protein, 126 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCARGGLEPRSVDYYYYGMDVWGQGTTVTVSS

SEQ ID NO: 4861 - protein, 103 aa, Artificial Sequence
  Description of Artificial Sequence: Synthetic polypeptide
DIQITQSPSSLSASVGDRVTITCRTSQSLSSYLHWYQQKPGKAPKLLIYAASSLQSGVPSRFSGSGSGTDFTLTISSLQPEDFATYYCQQSRTFGQGTKVEIK

SEQ ID NO: 4862 - protein, 103 aa, Artificial Sequence
  Description of Artificial Sequence: Synthetic polypeptide
DIQMTQSPSSLSASVGDRVTITCRTSQSLSSYLHWYQQKPGKAPKLLIYAASSLQSGVPSRFSGSGSGTDFTLTISSLQPEDFATYYCQQSRTFGQGTKVEIK

SEQ ID NO: 4863 - protein, 103 aa, Artificial Sequence; identical to SEQ ID NO: 4862
  Description of Artificial Sequence: Synthetic polypeptide

SEQ ID NO: 4864 - protein, 102 aa, Artificial Sequence
  Description of Artificial Sequence: Synthetic polypeptide
DIQVTQSPSSLSASVGDRVTISCRAQSLSSYLHWYQQKPGQPPKLLIYAATTLQSGVPSRFSGSGSGTDFTLTISTFQAEDVATYYCQQSRTFGQGTKVEIK

SEQ ID NO: 4865 - protein, 102 aa, Artificial Sequence
  Description of Artificial Sequence: Synthetic polypeptide
DIQMTQSPSSLSASVGDRVTISCRAQSLSSYLHWYQQKPGQPPKLLIYAATTLQSGVPSRFSGSGSGTDFTLTISTFQAEDVATYYCQQSRTFGQGTKVEIK

SEQ ID NO: 4866 - protein, 102 aa, Artificial Sequence; identical to SEQ ID NO: 4865
  Description of Artificial Sequence: Synthetic polypeptide

SEQ ID NO: 4867 - protein, 103 aa, Artificial Sequence
  Description of Artificial Sequence: Synthetic polypeptide
DIQVTQSPSSLSASVGDRVTISCRASQRLNSYLHWYQQTPGQAPKLLIYATSTLQSGVSPRFSGSGSGTDFTLTISSLQPEDVATYYCQLSRTFGHGTKVEIK

SEQ ID NO: 4868 - protein, 103 aa, Artificial Sequence
  Description of Artificial Sequence: Synthetic polypeptide
DIQMTQSPSSLSASVGDRVTISCRASQRLNSYLHWYQQTPGQAPKLLIYATSTLQSGVSPRFSGSGSGTDFTLTISSLQPEDVATYYCQLSRTFGHGTKVEIK

SEQ ID NO: 4869 - protein, 103 aa, Artificial Sequence
  Description of Artificial Sequence: Synthetic polypeptide
DIQVTQSPSSLSASVGDRITISCRTSQSLRSYLHWYQQKPGKAPKLLIYASSTLQSGVPSRFSGSGSGTDFTLTISNLQPEDFATYYCQLSRTFGQGTKVEIK

SEQ ID NO: 4870 - protein, 103 aa, Artificial Sequence
  Description of Artificial Sequence: Synthetic polypeptide
DIQMTQSPSSLSASVGDRITISCRTSQSLRSYLHWYQQKPGKAPKLLIYASSTLQSGVPSRFSGSGSGTDFTLTISNLQPEDFATYYCQLSRTFGQGTKVEIK

SEQ ID NO: 4871 - protein, 103 aa, Artificial Sequence
  Description of Artificial Sequence: Synthetic polypeptide
DIQMTQSPSSLSASVGDRVTITCRTSQSLSSYTHWYQQKPGKAPKLLIYAASSRLSGVPSRFSGSGSGTDFTLTISSLQPEDFATYYCQQSRTFGQGTKVEIK

SEQ ID NO: 4872 - protein, 103 aa, Artificial Sequence
  Description of Artificial Sequence: Synthetic polypeptide
DIQMTQSPSSLSASVGDRVTITCRTSQSLSSYTHWYQQKPGKAPKLLIYAASSRGSGVPSRFSGSGSGTDFTLTISSLQPEDFATYYCQQSRTFGQGTKVEIK

SEQ ID NO: 4873 - protein, 103 aa, Artificial Sequence
  Description of Artificial Sequence: Synthetic polypeptide
DIQMTQSPSSLSASVGDRVTITCRTSQSLSSYDHWYQQKPGKAPKLLIYAASSRLSGVPSRFSGSGSGTDFTLTISSLQPEDFATYYCQQSRTFGQGTKVEIK

SEQ ID NO: 4874 - protein, 103 aa, Artificial Sequence; identical to SEQ ID NO: 4871
  Description of Artificial Sequence: Synthetic polypeptide

SEQ ID NO: 4875 - protein, 103 aa, Artificial Sequence; identical to SEQ ID NO: 4872
  Description of Artificial Sequence: Synthetic polypeptide

SEQ ID NO: 4876 - protein, 103 aa, Artificial Sequence; identical to SEQ ID NO: 4862
  Description of Artificial Sequence: Synthetic polypeptide

SEQ ID NO: 4877 - protein, 99 aa, Artificial Sequence
  Description of Artificial Sequence: Synthetic polypeptide
DVVMTQSPLSLPVTLGQPASISCRSSRGLLYIDGNTYLNWFQQRPGQSPRRLIHNVSNRDSGVPDRFSGSGSRTDFTLKISRVEAEDVGVYYCMQGTYW

SEQ ID NO: 4878 - protein, 112 aa, Artificial Sequence
  Description of Artificial Sequence: Synthetic polypeptide
DVVMTQSPLSLPVTLGQPASISCRSSRGLLYIDGNTYLNWFQQRPGQSPRRLIHNVSNRDSGVPDRFSGSGSRTDFTLKISRVEAEDVGVYYCMQGTYWPFTFGQGTKVEIK

SEQ ID NO: 4879 - protein, 94 aa, Artificial Sequence
  Description of Artificial Sequence: Synthetic polypeptide
DIQMTQSPSTLSASVGDRVTITCRASQSIDNWLAWYQQKPGKAPNLLIYKASSLRSGVPSRFSGSGSGTEFTLTISSLQPDDFATYYCQHYDTY

SEQ ID NO: 4880 - protein, 107 aa, Artificial Sequence
  Description of Artificial Sequence: Synthetic polypeptide
DIQMTQSPSTLSASVGDRVTITCRASQSIDNWLAWYQQKPGKAPNLLIYKASSLRSGVPSRFSGSGSGTEFTLTISSLQPDDFATYYCQHYDTYSGTFGQGTKVEIK

SEQ ID NO: 4881 - protein, 94 aa, Artificial Sequence
  Description of Artificial Sequence: Synthetic polypeptide
DIQMTQSPSTLSASVGDRVTITCRASQSIGSWLAWYQQKPGKAPKLLIYKASTLESGVPSRFSGSGSGTEFTLTISSLQPDDLATYYCQQHNSY

SEQ ID NO: 4882 - protein, 125 aa, Artificial Sequence; identical to SEQ ID NO: 4414
  Description of Artificial Sequence: Synthetic polypeptide

SEQ ID NO: 4883 - protein, 96 aa, Artificial Sequence
  Description of Artificial Sequence: Synthetic polypeptide
EIVLTQSPGTLSLSPGERATLSCRASQSVSSNYLAWYQQKPGQAPRLLIYGASNRATGIPDRFSGSGSGTDFTLAISRLEPEDFAVYYCQQYGTSP

SEQ ID NO: 4884 - protein, 131 aa, Artificial Sequence
  Description of Artificial Sequence: Synthetic polypeptide
EVQLVESGAEVKKPGSSVKVSCRASGTFYKYAINWVRQAPGQGLEWMGGIIPFFGTTNYAQKFQGRLTITADGSTNTAYMQLDSLRSEDTAVYYCAGPSITESHYCLDCAAKDYYYGLDVWGQGTTVTVSS

SEQ ID NO: 4885 - protein, 111 aa, Artificial Sequence
  Description of Artificial Sequence: Synthetic polypeptide
QSVLTQPPSASGTPGQRVTISCSGSSSNIGSNFVYWYQQLPGTAPKLLIYRNNQRPSGVPDRFSGSRSGTSASLAISGLRSEDEADYYCAAWDDSLSGAVFGGGTQLTVLG

SEQ ID NO: 4886 - protein, 111 aa, Artificial Sequence
  Description of Artificial Sequence: Synthetic polypeptide
QSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGVFGGGTKLTVLG

SEQ ID NO: 4887 - protein, 111 aa, Artificial Sequence
  Description of Artificial Sequence: Synthetic polypeptide
QSVLTQPPSVSAAPGQKVTISCSGSTSNIGDNYVSWYQQVPGTAPKLLIYDNNQRPSGIPDRFSGSKSGTSATLGITGLQTGDEADYYCGTWDSSLSAVLFGGGTKLTVLR

SEQ ID NO: 4888 - protein, 111 aa, Artificial Sequence
  Description of Artificial Sequence: Synthetic polypeptide
QSVLTQPPSASGTPGQRVTISCSGGTSNIGSNTVNWYQQLPGTAPKLLMYSNNQRPSGVPDRFSGSKSGTSASLAISGLQSEDEADYYCAAWDDSLNGVVFGGGTKLTVLG

SEQ ID NO: 4889 - protein, 111 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGVVFGGGTKLTVLG

SEQ ID NO: 4890 - protein, 112 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGHAVFGGGTQLTVLG

SEQ ID NO: 4891 - protein, 111 aa, Artificial Sequence
  Description of Artificial Sequence: Synthetic polypeptide
QSVLTQPPSASGTPGQRVTISCSGGTSNIGSNTVNWYQQLPGTAPKLLMYNNNQRPSGVPDRFSGSKSGTSASLAISGLQSEDEADYYCAAWDDSLNGVVFGGGTKLTVLG

SEQ ID NO: 4892 - protein, 111 aa, Artificial Sequence
  Description of Artificial Sequence: Synthetic polypeptide
QSVLTQPPSASGTPGQRVTISCSGSSSNIGSNTVNWYQQLPGTAPKLLIYSNNQRPSGAPDRFSGSKSGTSASLAISGLQSEDEADYYCAAWDDSLNGYVFGTGTKVTVLG

SEQ ID NO: 4893 - protein, 111 aa, Artificial Sequence
  Description of Artificial Sequence: Synthetic polypeptide
QSVLTQPPSVSAAPGQKVTISCSGSSSNIGNNDVSWYQQLPGTAPKLLLYDDNKRPSGVSDRFSGSKSGASATLDITGLQTGDEADYYCGTWDNILSVVLFGGGTRLTVLS

SEQ ID NO: 4894 - protein, 111 aa, Artificial Sequence
  Description of Artificial Sequence: Synthetic polypeptide
QSVLTQPPSASGTPGQRVTISCSGSNSNIGSNTVNWYQQLPGTAPKLLIYTNNQRPSGVPDRFSGSKSGTSASLAISGLQSEDEADYYCASWDDSLNGVVFGGGTKLTVLG

SEQ ID NO: 4895 - protein, 111 aa, Artificial Sequence
  Description of Artificial Sequence: Synthetic polypeptide
QSVLTQPPSASGTPGQSVTISCSGSRSNIGGNTVNWYQHLPGMAPKLLIYSSNQRSSGVPDRFSGSKSGTSASLAISGLQSEDDADYYCASWDDSLNGVVFGGGTKLTVLG

SEQ ID NO: 4896 - protein, 111 aa, Artificial Sequence; identical to SEQ ID NO: 4893
  Description of Artificial Sequence: Synthetic polypeptide

SEQ ID NO: 4897 - protein, 109 aa, Artificial Sequence
  Description of Artificial Sequence: Synthetic polypeptide
EIVLTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIK

SEQ ID NO: 4898 - protein, 109 aa, Artificial Sequence
  Description of Artificial Sequence: Synthetic polypeptide
EIVLTQSPATLSVSPGERATLSCRASQSVSHNLAWYQQKPGQAPRLLVYSASTRATGIPARFSGSGSGTEFTLAISSLQSEDFAVYYCQHYTNYPPRLTFGGGSKVEIK

SEQ ID NO: 4899 - protein, 109 aa, Artificial Sequence
  Description of Artificial Sequence: Synthetic polypeptide
EIVMTQSPATLSVSPGERATLSCRASQSVDSNLAWYQQKPGQAPRLLVYSASTRATGIPARFSGSGSGTEFTLAISSLQSEDFAVYYCQHYTNWPPRLTFGGGSKVEIK

SEQ ID NO: 4900 - protein, 109 aa, Artificial Sequence
  Description of Artificial Sequence: Synthetic polypeptide
EIVLTQSPATLSVSPGERATLSCRASQSVSSNLAWYQQKPGQAPRLLVYSASTRATGIPARFSGSGSGTEFTLAISSLQSEDFAVYYCQHYTNWPPRLTFGGGSKVEIK

SEQ ID NO: 4901 - protein, 109 aa, Artificial Sequence
  Description of Artificial Sequence: Synthetic polypeptide
EIVLTQSPATLSVSPGERATLSCRASQSVDHNLAWYQQKPGQAPRLLVYSASTRATGIPARFSGSGSGTEFTLAISSLQSEDFAVYYCQHYTNWPPRLTFGGGSKVEIK

SEQ ID NO: 4902 - protein, 109 aa, Artificial Sequence
  Description of Artificial Sequence: Synthetic polypeptide
EIVLTQSPATLSVSPGERATLSCRASQSVSHNLAWYQQKPGQAPRLLVYSASTRATGIPARFSGSGSGTEFTLAISSLQSEDFAVYYCQHYTNWPPRLTFGGGSKVEIK

SEQ ID NO: 4903 - protein, 109 aa, Artificial Sequence
  Description of Artificial Sequence: Synthetic polypeptide
EIVLTQSPATLSVSPGERATLSCRASQSVSHNLAWYQQKPGQAPRLLVYSASTRATGIPARFSGSGSGTEFTLAISSLQSEDFAVYYCQHYTNFPPRLTFGGGSKVEIK

SEQ ID NO: 4904 - protein, 109 aa, Artificial Sequence
  Description of Artificial Sequence: Synthetic polypeptide
EIVLTQSPATLSVSPGERATLSCRASQSVDSNLAWYQQKPGQAPRLLVYSASTRATGIPARFSGSGSGTEFTLAISSLQSEDFAVYYCQHYTNFPPRLTFGGGSKVEIK

SEQ ID NO: 4905 - protein, 109 aa, Artificial Sequence
  Description of Artificial Sequence: Synthetic polypeptide
EIVLTQSPATLSVSPGERATLSCRASQSVDSNLAWYQQKPGQAPRLLVYSASTRATGIPARFSGSGSGTEFTLAISSLQSEDFAVYYCQHYTNYPPRLTFGGGSKVEIK

SEQ ID NO: 4906 - protein, 109 aa, Artificial Sequence
  Description of Artificial Sequence: Synthetic polypeptide
ETTLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4907 - protein, 109 aa, Artificial Sequence
  Description of Artificial Sequence: Synthetic polypeptide
EIVLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4908 - protein, 109 aa, Artificial Sequence
  Description of Artificial Sequence: Synthetic polypeptide
EIVLTQSPATLSVSPGERATLSCRASQVISHNLAWYQQKPGQAPRLLIYGASTRASGIPARFSGSGSGTDYTLTITSLQPEDFAVYYCQHYSNWPPRLTFGGGTKVEIK

SEQ ID NO: 4909 - protein, 109 aa, Artificial Sequence
  Description of Artificial Sequence: Synthetic polypeptide
EIVMTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIK

SEQ ID NO: 4910 - protein, 109 aa, Artificial Sequence
  Description of Artificial Sequence: Synthetic polypeptide
EIVLTQSPATLSVSPGERATLSCRASQVISHNLAWYQQKPGQAPRLLIYGASTRASGIPARFSGSGSGTDYTLTITSLQSEDFAVYYCQHYSNFPPRLTFGGGTKVEIK

SEQ ID NO: 4911 - protein, 109 aa, Artificial Sequence
  Description of Artificial Sequence: Synthetic polypeptide
EIVLTQSPATLSVSPGERATLSCRASQVISHNLAWYQQKPGQAPRLLIYGASTRASGIPARFSGSGSGTDYTLTITSLQSEDFAVYYCQHYSNYPPRLTFGGGTKVEIK

SEQ ID NO: 4912 - protein, 109 aa, Artificial Sequence
  Description of Artificial Sequence: Synthetic polypeptide
DIVMTQSPSTLSASVGDRVTITCRASQSIGNWLAWYQQKPGKAPKLLIYKVSTLESGVPSRFSGSGSGTEFTLTINSLQPDDFATYYCQRYTSNSQGFTFGQGTKLEIK

SEQ ID NO: 4913 - protein, 110 aa, Artificial Sequence
  Description of Artificial Sequence: Synthetic polypeptide
SSELTQPPSASGTPGQRVTISCSGSTSNIGYNPVSWYQQVPGTAPKLLIYSNTERPSGVPDRFSGSKSGTSASLAISGLQSEDEADYYCAAWDDTLNGPVFGGGTKVTVL

SEQ ID NO: 4914 - protein, 112 aa, Artificial Sequence
  Description of Artificial Sequence: Synthetic polypeptide
DIQLTQSPLSPPVTLGQPASISCRSSQSLLYTDGFTYLSWYHQRPGQSPRRLIYKISNRDSGVPDRFSGSGSGTDFTLKISRVEAEDVGVYYCMQATHWPLTFGEGTKVEIK

SEQ ID NO: 4915 - protein, 109 aa, Artificial Sequence; identical to SEQ ID NO: 4907
  Description of Artificial Sequence: Synthetic polypeptide

SEQ ID NO: 4916 - protein, 111 aa, Artificial Sequence; identical to SEQ ID NO: 4828
  Description of Artificial Sequence: Synthetic polypeptide

SEQ ID NO: 4917 - protein, 111 aa, Artificial Sequence; identical to SEQ ID NO: 4829
  Description of Artificial Sequence: Synthetic polypeptide

SEQ ID NO: 4918 - protein, 108 aa, Artificial Sequence
  Description of Artificial Sequence: Synthetic polypeptide
EIVLTQSPGTLSVSPGERATLSCRASQSISSGYLAWYQQKPGQAPRLLIYGASSRATGIPDRFSGSGSGTDFTLTISRLEPEDFAVYYCQQYGTSPQTFGQGTKVEIK

SEQ ID NO: 4919 - protein, 112 aa, Artificial Sequence
  Description of Artificial Sequence: Synthetic polypeptide
DIVMTQTPLSLSVTPGQPASISCKSSQSLLHSDGKTYLYWYLQKPGQSPQLLIYEVSNRFSGVPDRFSGSGSGTDFTLKISRVEAEDVGVYYCMQNILLPLTFGGGTKVEIK

SEQ ID NO: 4920 - protein, 111 aa, Artificial Sequence
  Description of Artificial Sequence: Synthetic polypeptide
QSALTQPASVSGSPGQSITISCTGTGSDVGSSNLVSWYQQHPAKAPKLIIYEVTKRPSGVSNRFSGSKSGNTASLTISGLQAEDEADYYCCSYAGSSSSRVFGTGTKVTVL

SEQ ID NO: 4921 - protein, 110 aa, Artificial Sequence
  Description of Artificial Sequence: Synthetic polypeptide
QSVLTQPPSASGAPGQRVTLSCSGSGSNIGSNTVSWYQQLPGTAPKLLVFTNNQRPSGVPDRFSGSKSGTSASLAISGLQSEDEADYYCAAWDDSLNGQLFGGGTKLTVL

SEQ ID NO: 4922 - protein, 112 aa, Artificial Sequence
  Description of Artificial Sequence: Synthetic polypeptide
EIVMTQTPLSLSVTPGQPASISCRSSQSLLHSDGKTYLYWYLQKPGQPPQLLISEVFNRFSGVPDRFSGSGSGTDFTLKISRVEAEDVGVYYCMQSLQLPLTFGGGTKVEIK

SEQ ID NO: 4923 - protein, 107 aa, Artificial Sequence
  Description of Artificial Sequence: Synthetic polypeptide
DIQMTQSPSSLSASVGDRVSITCQASQDISRYLNWYQQKPGEAPKLLIYDASNLETGVPSRFSGSGSGTDFTFTISSLQPEDIATYFCQQYGYLPLTFGPGTKVDSK

SEQ ID NO: 4924 - protein, 238 aa, Artificial Sequence; identical to SEQ ID NO: 4719
  Description of Artificial Sequence: Synthetic polypeptide

SEQ ID NO: 4925 - protein, 238 aa, Artificial Sequence; identical to SEQ ID NO: 4720
  Description of Artificial Sequence: Synthetic polypeptide

SEQ ID NO: 4926 - protein, 242 aa, Artificial Sequence; identical to SEQ ID NO: 4721
  Description of Artificial Sequence: Synthetic polypeptide

SEQ ID NO: 4927 - protein, 177 aa, Artificial Sequence
  Description of Artificial Sequence: Synthetic polypeptide
DVQMTQSPSSLSASVGDRVTITCRASQSVSNYVNWYQQKPGRAPRLLISSASNLWAGVPPRFSGRGEETDFTLTITSLQPEDSAVYYCQQSYSDLLSFGGGTKVEIKRTVAAPSVFTFPPSDEQLKSGTASVVCLLNNFYPREAKVQWKVDNALQSGNSQESVTEQDSKDSTYSLSS

SEQ ID NO: 4928 - protein, 210 aa, Artificial Sequence
  Description of Artificial Sequence: Synthetic polypeptide
QTVVTQEPSFSVSPGGTVTLTCGLSSGSVSPSYYASWYQQTPGQAPRTLIYNTNTRSSGVPDRFSGSFLGSDAALTITGAQADDESDYFCVLYMPSGDWVFGGGTKLTVLGQPKAAPSVTLFPPSSEELQANKATLVCLISDFYPGAVTVARKADSSPVKAGVETTTPSKQSNNKYAASSYLSLTPEQWKSHKSYSCQVTHEESTVEKTM

SEQ ID NO: 4929 - protein, 171 aa, Artificial Sequence
  Description of Artificial Sequence: Synthetic polypeptide
EIVLAQSPATLSLSPGERATLSCRASETVDTYLAWYQQKPGQAPRLLINDASKRATGIPARFSGSGSGTDFTLTISGLEPEDFAVYWCQQHSNWPPTFGQGSRLEIKRTVAAPSVFIFPPSDEQLKSGTASVVCLLNNFYPREAKVQWKVDNALQSGNSQESVTEQDSKDS

SEQ ID NO: 4930 - protein, 210 aa, Artificial Sequence
  Description of Artificial Sequence: Synthetic polypeptide
QSVLAQPPSASGTPGQRVIISCSGTSSNIGGNSVNWYQHPPGAAPRLLIYTTDQRPSGVPDRFSGSKSGTSASLAISGLQSEDEADYYCEVWDDSLTRPVFGGGTKLTVLRQPKAAPSVTLFPPSSEELQANKATLVCLISDFYPGAVTVAWKADSSPVKAGVETTTPSKQSNNKYAASSYLSLTPEQWKSHKSYSCQVTHEESTVEKTM

SEQ ID NO: 4931 - protein, 127 aa, Artificial Sequence
  Description of Artificial Sequence: Synthetic polypeptide
MEAPAQLLFLLLLWLPDTSGEIGMTQSPATLSVSPGERATLFCRASPSISDNLAWYQQKPGQAPRLLFYGASTRATGIPARFSGSGSGTEFTLTISSVQSEDIGVYYCQQYSNWPRTFGQGTKLQIK

SEQ ID NO: 4932 - protein, 129 aa, Artificial Sequence
  Description of Artificial Sequence: Synthetic polypeptide
MAWVSFYLTLLTHCAGSWAQSVLTQPPSASGTPGQRVTISCSGSSSNIGSNDVYWYQNLPGTAPKLLIYNNNQRPSGVPDRFSGSKSGTSASLAISGLRSEDEADYYCAAWDDSLTVSFGTGTKVTVLG

SEQ ID NO: 4933 - protein, 130 aa, Artificial Sequence
  Description of Artificial Sequence: Synthetic polypeptide
MPWALLLLTLLTHCAGSWAQSVLTQPPSASGTPGQRVSISCSGGSSNIGSNTVNWYQQLPGTAPRLLIYSNNQRPLGVPDRFSESKSGTSASLAISGLRSEDEADYYCAAWDDSLNGWVFGGGTRLTVLG

SEQ ID NO: 4934 - protein, 100 aa, Artificial Sequence
  Description of Artificial Sequence: Synthetic polypeptide
ELTQSPSSLSASVGDSVTITCRTSERISTYLNWYQQKPGKAPRLLVSGASTLQGGVPSRFSGSGSGTAFTLTINSLQPEDFATYYCQQSYSTPLTFGGGT

SEQ ID NO: 4935 - protein, 105 aa, Artificial Sequence; identical to SEQ ID NO: 4794
  Description of Artificial Sequence: Synthetic polypeptide

SEQ ID NO: 4936 - protein, 107 aa, Artificial Sequence
  Description of Artificial Sequence: Synthetic polypeptide
DIQLTQSPSSLSASVGDRVTITCRASQGIRNDLGWYQQKPGNAPKRLIFGASSLQSGVPSRFSGSGSGTEFTLTISSLQPEDFATYYCLQHNSYPYTFGQGTKLEIK

SEQ ID NO: 4937 - protein, 101 aa, Artificial Sequence
  Description of Artificial Sequence: Synthetic polypeptide
QSALTQPASVSGSPGQSITISCTGTSSDVGGYNYVSWYQQHPGKAPKLMIYEVSHRPSGVSNRFSGSKSGSTASLTISGLQSEDEADYYCSSYTGEGPLGV

SEQ ID NO: 4938 - protein, 98 aa, Artificial Sequence
  Description of Artificial Sequence: Synthetic polypeptide
  MOD_RES (4)..(4): Any amino acid
DIQXTQSPSSLSASVDDRVTITCRASQSISGYLNWYQQKPGKAPNLLIYGASTLQSGVPSRFSGSGSGTDFTLTITSLQPEDYATYYCQQTYTSPPYA

SEQ ID NO: 4939 - protein, 98 aa, Artificial Sequence
  Description of Artificial Sequence: Synthetic polypeptide
  MOD_RES (4)..(4): Any amino acid
EIVXTQSPGTLSLSPGERATLSCRASQSVSMNYLAWFQQKPGQAPRLLIYGASRRATGIPDRISGSGSGTDFTLTISRLEPADFAVYYCQQYGTSPRT

SEQ ID NO: 4940 - protein, 103 aa, Artificial Sequence
  Description of Artificial Sequence: Synthetic polypeptide
  MOD_RES (4)..(4): Any amino acid
DIQXTQSPDSLAVSLGERATINCKSSQSIFYSSNNKNYLTWYQQKPGQPPKLLIYWASTRESGVPDRFSGSGSGTDFTLTISSLQAEDVAVYYCQQYYSIPYT

SEQ ID NO: 4941 - protein, 103 aa, Artificial Sequence
  Description of Artificial Sequence: Synthetic polypeptide
DIVMTQTPDSLAVSLGERATINCKSSQSVLYSSIHKNYLAWYQQKPGQPPKLLIYWASTRESGVPDRFSGSGSGTDFTLTISSLQAEDVAVYYCQQYYRSPPT

SEQ ID NO: 4942 - protein, 100 aa, Artificial Sequence
  Description of Artificial Sequence: Synthetic polypeptide
QSALTQPPSASGSPGQSVTISCTGTSSDVGGYNYVSWYQQHPGKAPKLMIREVSKRPSGVPDRFSGSKSGNTASLTVSGLQAEDEAEYYCSSYAGSNNLI

SEQ ID NO: 4943 - protein, 97 aa, Artificial Sequence
  Description of Artificial Sequence: Synthetic polypeptide
EIVLTQSPDFQSVTPKERVTITCRASQGIGSNLHWYQQKPDQSPKLLIKYASQSITGVPSRFSGRGSGTDFTLTINSLEVEDAAVYYCHQSSSLPLT

SEQ ID NO: 4944 - protein, 98 aa, Artificial Sequence
  Description of Artificial Sequence: Synthetic polypeptide
EIVLTQSPGTLSLSPGERATLSCRASQSVSSNYLAWFQQKPGQAPRLLIYGASRRATGIPDRFSGSGSGTDFTLTISRLEPEDFAVYYCQQYDSSPRT

SEQ ID NO: 4945 - protein, 103 aa, Artificial Sequence
  Description of Artificial Sequence: Synthetic polypeptide
  MOD_RES (4)..(4): Any amino acid
DIQXTQSPDSLAVSLGERATINCKSSQSVFSSSTNKNYLAWYQQKPGQPPKVLIYWSSTRESGVPDRFSASGSGTDFTLTISSLQAADVAVYYCHQYYTAPWT

SEQ ID NO: 4946 - protein, 98 aa, Artificial Sequence
  Description of Artificial Sequence: Synthetic polypeptide
QSVLTQPPSVSVAPGQTARLTCEGDTIGSKSVHWYQQRPGQAPVLVVYNDRDRPSGIPERFSGSNSGRTATLTISRVEAGDEADYFCQVWESGGDQTV

SEQ ID NO: 4947 - protein, 98 aa, Artificial Sequence
  Description of Artificial Sequence: Synthetic polypeptide
EIVMTQSPGTLSLSPGERATLSCRASQSVSRNYLAWYQQKPGLAPRLLISGASSRATGVPDRFSGRGSDTDFTLTISRLEPEDFAVYYCQHYGSVLVA

SEQ ID NO: 4948 - protein, 97 aa, Artificial Sequence
  Description of Artificial Sequence: Synthetic polypeptide
DIQLTQSPSSLSASVGDRVTITCRASQGINTYLNWYQQKPGKAPKVLIFAASTLQSGVPSRFSGSGSGTEFTLNINNLQPEDFATYYCQQSYSTAIT

SEQ ID NO: 4949 - protein, 97 aa, Artificial Sequence
  Description of Artificial Sequence: Synthetic polypeptide
EIVLTQSPDFQSVAPKEKVTITCRASRSIGSDLHWFQQRPDQSPKLLIKFASQSMSGVPSRFSGSGSGRDFTLTISSLEAEDAATYYCHQSSSLPLT

SEQ ID NO: 4950 - protein, 100 aa, Artificial Sequence
  Description of Artificial Sequence: Synthetic polypeptide
QSALTQPASVSGSPGQSITISCTGSSGDIGGYNAVSWYQHHPGKAPKLMIYEVTSRPSGVSDRFSASRSGDTASLTVSGLQAEDEAHYYCCSFADSNILI

SEQ ID NO: 4951 - protein, 99 aa, Artificial Sequence
  Description of Artificial Sequence: Synthetic polypeptide
EIVLTQSPATLSVSPGERATLSCRASQNVNYNLAWYQQKPGQAPRLLIYVASTRATGIPDRFSGSGSGTEFTLTISSLQSEDFAVYYCQQYNNWPPAIT

SEQ ID NO: 4952 - protein, 220 aa, Artificial Sequence
  Description of Artificial Sequence: Synthetic polypeptide
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4953 - protein, 220 aa, Artificial Sequence
  Description of Artificial Sequence: Synthetic polypeptide
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4954 - protein, 220 aa, Artificial Sequence
  Description of Artificial Sequence: Synthetic polypeptide
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4955 - protein, 221 aa, Artificial Sequence
  Description of Artificial Sequence: Synthetic polypeptide
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4956 - protein, 214 aa, Artificial Sequence
  Description of Artificial Sequence: Synthetic polypeptide
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4957 - protein, 216 aa, Artificial Sequence
  Description of Artificial Sequence: Synthetic polypeptide
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4958 - protein, 213 aa, Artificial Sequence
  Description of Artificial Sequence: Synthetic polypeptide
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4959 - protein, 218 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4960 - protein, 220 aa, Artificial Sequence
  Description of Artificial Sequence: Synthetic polypeptide
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4961 - protein, 214 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4962 - protein, 220 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4963 - protein, 218 aa, Artificial Sequence
  Description of Artificial Sequence: Synthetic polypeptide
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4964 - protein, 220 aa, Artificial Sequence
  Description of Artificial Sequence: Synthetic polypeptide
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4965 - protein, 219 aa, Artificial Sequence
  Description of Artificial Sequence: Synthetic polypeptide
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4966 - protein, 220 aa, Artificial Sequence
  Description of Artificial Sequence: Synthetic polypeptide
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4967 - protein, 214 aa, Artificial Sequence
  Description of Artificial Sequence: Synthetic polypeptide
EIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4968 - protein, 218 aa, Artificial Sequence
  Description of Artificial Sequence: Synthetic polypeptide
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4969 - protein, 218 aa, Artificial Sequence
  Description of Artificial Sequence: Synthetic polypeptide
SYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4970 - protein, 213 aa, Artificial Sequence
  Description of Artificial Sequence: Synthetic polypeptide
EIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4971 - protein, 218 aa, Artificial Sequence
  Description of Artificial Sequence: Synthetic polypeptide
EIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKRAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4972 - protein, 212 aa, Artificial Sequence
  Description of Artificial Sequence: Synthetic polypeptide
DIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4973 - protein, 218 aa, Artificial Sequence
  Description of Artificial Sequence: Synthetic polypeptide
SYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4974 - protein, 214 aa, Artificial Sequence
  Description of Artificial Sequence: Synthetic polypeptide
EIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4975 - protein, 218 aa, Artificial Sequence
  Description of Artificial Sequence: Synthetic polypeptide
QAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4976 - protein, 219 aa, Artificial Sequence
  Description of Artificial Sequence: Synthetic polypeptide
DIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4977 - protein, 218 aa, Artificial Sequence
  Description of Artificial Sequence: Synthetic polypeptide
QSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 4978 - protein, 108 aa, Artificial Sequence
  Description of Artificial Sequence: Synthetic polypeptide
SYVLTQPPSVSVAPGQTATISCGGDNVGSNSVHWYQQKPGQAPVLVVYDDRDRPSGIPERFSGSNSGNTATLTISRVEAGDEADYYCQVWDSSSDHRVFGTGTKVTVL

SEQ ID NO: 4979 - protein, 110 aa, Artificial Sequence
  Description of Artificial Sequence: Synthetic polypeptide
QSVLTQPPAVSGTPGQRVTISCSGSDSNIGRRSVNWYQQFPGTAPKLLIYSNDQRPSVVPDRFSGSKSGTSASLAISGLQSEDEAEYYCAAWDDSLKGAVFGGGTQLTVL

SEQ ID NO: 4980 - protein, 110 aa, Artificial Sequence
  Description of Artificial Sequence: Synthetic polypeptide
QSALTQPASVSGSPGQSITISCTGTSSDVGGYNYVSWYQQHPGKAPKLLIFDVSDRPSGVSDRFSGSKSADTASLTISGLQAQDEADYYCCSYAGSAKGVFGTGTKVTVL

SEQ ID NO: 4981 - protein, 110 aa, Artificial Sequence
  Description of Artificial Sequence: Synthetic polypeptide
SYVLTQPPSVSVAPGQTARITCGGNNIGSKTVHWYQQNSGQAPVLVVYGDSDRPSGIPERFSGSNSGTTATLTISRVEAGDEADYYCQVWDSSSDHPGAVFGGGTQLTVL

SEQ ID NO: 4982 - protein, 110 aa, Artificial Sequence
  Description of Artificial Sequence: Synthetic polypeptide
SYVLTQPPSASGTPGQRVTISCSGSSSNIGSNTVNWYQQVPGTAPKLLIYGDDQRPSGVPDRFSGSKSGTSASLAISGLQSEDEADYYCATWDDSLNGHVFGGGTQLTVL

SEQ ID NO: 4983 - protein, 110 aa, Artificial Sequence; identical to SEQ ID NO: 4981
  Description of Artificial Sequence: Synthetic polypeptide

SEQ ID NO: 4984 - protein, 107 aa, Artificial Sequence
  Description of Artificial Sequence: Synthetic polypeptide
DIQMTQSPSSVSASVGDRVTITCRASQHISSWLAWYQQKPGKGPQLLIYSASRLQSGVPSRFSGSGSGTDFTLTISSLQPEDFATYYCQQANSFPLTFGPGTKVDIK

SEQ ID NO: 4985 - protein, 110 aa, Artificial Sequence
  Description of Artificial Sequence: Synthetic polypeptide
SYVLTQPPSVSVAPGQTARITCGGNNIGSKTVHWYQQNSGQAPVLVVFVDSDRPSGIHERFCGSNSGSTATLTISSVEAGDEADYYCQVWDSNSDHPGAVFGGGTQLTVL

SEQ ID NO: 4986 - protein, 110 aa, Artificial Sequence
  Description of Artificial Sequence: Synthetic polypeptide
SYVLTQPPAVSGTPGQRVTISCSGSDSNIGRRSVNWYQQFPGTAPKLLIYSNDQRPSVVPDRFSGSKSGTSASLAISGLQSEDEAEYYCAAWDDSLKGAVFGGGTQLTVL

SEQ ID NO: 4987 - protein, 111 aa, Artificial Sequence
  Description of Artificial Sequence: Synthetic polypeptide
QSVVTQPPSVSGAPGQRVTISCTGSSSNIGAGYDVHWYQQLPGTAPKLLIYGNNNRPSGVPDRFSGSKSGTSASLAITGLQVEDEADYYCQSYDQNLSEGVFGGGTKLTVL

SEQ ID NO: 4988 - protein, 107 aa, Artificial Sequence
  Description of Artificial Sequence: Synthetic polypeptide
EIVMTQSPGTLSLSPGERGTLSCRASQSVSSYLAWYQQKPGQAPRLLIYGASTRATGIPDRFTGSGSGTDFTLTISRLEPEDFAVYYCQQYGSSPFAFGPGTKVEIK

SEQ ID NO: 4989 - protein, 110 aa, Artificial Sequence
  Description of Artificial Sequence: Synthetic polypeptide
SYVLTQPPSVSVAPGQTARITCGGNNIGSKSVHWYQQKPGQAPVLVVYGDSDRPSGIPERFSGSNSGTTATLTISRVEAGDEADYYCQVWDSSSDHPGAVFGGGTQLTVL

SEQ ID NO: 4990 - protein, 113 aa, Artificial Sequence
  Description of Artificial Sequence: Synthetic polypeptide
QSVLTQPPSVSGAPGQRVTISCTGSSSNIGAGYDVHWYQQLPETAPKLLIYDNNNRPSGVSDRFSGSKSGTSASLAITGLQAEDEADYYCQSYDSGLSASPYVFGAGTKVTVL

SEQ ID NO: 4991 - protein, 111 aa, Artificial Sequence
  Description of Artificial Sequence: Synthetic polypeptide
QSVLTQPPSVSGAPGQRVTISCTGSSANIGAGYDVHWYQQFPGTAPKLLIYGNNNRPSGVPDRFSGSKSGTSASLAITGLQAEDEADYYCQSYDSSLSGALFGGGTKLTVL

SEQ ID NO: 4992 - protein, 110 aa, Artificial Sequence
  Description of Artificial Sequence: Synthetic polypeptide
QSVLTQPPAVSGTPGQRVTISCSGSDSNIGRRSVNWYQQFPGTAPKLLIYSNDQRPSVVPDRFSGSKSGTSASLAISGLQAEDEADYYCAAWDASLSGPVFGGGTQLTVL

SEQ ID NO: 4993 - protein, 110 aa, Artificial Sequence; identical to SEQ ID NO: 4986
  Description of Artificial Sequence: Synthetic polypeptide

SEQ ID NO: 4994 - protein, 108 aa, Artificial Sequence
  Description of Artificial Sequence: Synthetic polypeptide
EIVLTQSPGTLSLSPGERATLSCRASQSVSSSYLAWYQQKPGQAPRLLIYGASTRATGIPARFSGSGSGTDFTLTISRLEPEDLAVYYCQQYGSSPWTFGQGTKVEIK

SEQ ID NO: 4995 - protein, 110 aa, Artificial Sequence
  Description of Artificial Sequence: Synthetic polypeptide
SYVLTQPPSASGTPGQRVTISCSGSSSNIGTNYVYWYQQFPGTAPKLLIYRSYQRPSGVPDRFSGSKSGSSASLAISGLQSEDEADYYCATWDDSLNGWVFGGGTKLTVL

SEQ ID NO: 4996 - protein, 112 aa, Artificial Sequence
  Description of Artificial Sequence: Synthetic polypeptide
QSVLTQPPSASGTPGQRVTISCSGSSSNIGTNYVYWYQQFPGTAPKLLIYRSYQRPSGVPDRFSGSKSGSSASLAISGLQSEDEADYYCATWDDSLDGWVFGGGTKLTVLRK

SEQ ID NO: 4997 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLCSFGQGTKLEIK

SEQ ID NO: 4998 - protein, 112 aa, Artificial Sequence
  Description of Artificial Sequence: Synthetic polypeptide
DVVMTQSPLSLPVTPGEPASISCRSSQSLLHSNGLNYLDWYLQKPGQSPQLLIYLGSNRASGVPDRFSGSGSGTDFTLKISRVEAEDVGVYYCMQALQTPFTFGGGTKVEIK

SEQ ID NO: 4999 - protein, 110 aa, Artificial Sequence
  Description of Artificial Sequence: Synthetic polypeptide
QSALTQPPSASGSPGQSVTISCTGTSSDVGGYNYVSWYQQHPGKAPKLMIYDVSKRPSGVPDRFSGSKSGNTASLTISGLQAEDEAEYYCSSYASGSTYVFGTGTKVTVL

SEQ ID NO: 5000 - protein, 111 aa, Artificial Sequence
  Description of Artificial Sequence: Synthetic polypeptide
EIVLTQSPLSLPVTPGEPASISCRSSQSLRHENGYNYLDWYLQKPGQSPQLLMYLGSVRASGVPDRFSGSGSGTDFTLKISRVEAEDVGVYYCMQALQTLTFGGGTKLEIK

SEQ ID NO: 5001 - protein, 107 aa, Artificial Sequence
  Description of Artificial Sequence: Synthetic polypeptide
DIQMTQSPSSLAASIGDSVTITCRASQSVGSYLNWYQQKPGKAPKLLIYGASNVQSGVPSRFSGSESGTESTLTINNLQPEDSATYYCQQSYSTPRTFGQGTKVEIK

SEQ ID NO: 5002 - protein, 108 aa, Artificial Sequence
  Description of Artificial Sequence: Synthetic polypeptide
EIVLTQSPGTLSLSPGERATLSCRASQSVSSDFFAWYQQKRGQTPTLLIYGTSTRATGIPDRFSGSGSGTDFTLSVARLEPEDFAVYYCQQYGSSTWTFGQGTKVEIK

SEQ ID NO: 5003 - protein, 110 aa, Artificial Sequence
  Description of Artificial Sequence: Synthetic polypeptide
SYELTQPPSASGTPGQRVTMSCSGSRSNIGSNPVSWFQQLPGMVPKLLIYTNDQRPSGVPDRFSGSKSGPSASLAISGLQSEDEADYYCAAWDDSLKGWVFGGGTKLTVL

SEQ ID NO: 5004 - protein, 106 aa, Artificial Sequence
  Description of Artificial Sequence: Synthetic polypeptide
IQMTQSPSSLSASIGDRVAITCQASQDISDYLNWYQQQPGKAPKLLLYGASNLETGVPSRFSGSGSGTDFTFTISSLQPEDIATYYCQQYGNLPPTFGGGTKLEIK

SEQ ID NO: 5005 - protein, 110 aa, Artificial Sequence
  Description of Artificial Sequence: Synthetic polypeptide
QSALTQPASVSGSPGQSITISCTGTSSDVGGYNYVSWYQQHPGKAPKLMIYDVSSRPSGVSNRFSGSKSGDTASLSISGLQAEDEADYYCSSYTSSSTHVFGTGTKVTVL

SEQ ID NO: 5006 - protein, 110 aa, Artificial Sequence
  Description of Artificial Sequence: Synthetic polypeptide
QSALTQPASVSGSPGQSITISCTGTRRDVGDYKYVSWYQQHPGKAPKLMIYDVSNRPSGVSNRFSGSKSGTTASLTISGLQAEDEADYYCSSYTTSNTRVFGGGTKLTVL

SEQ ID NO: 5007 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTDFTLTISSLQPEDFATYYCQQANTYPLTFGGGTKLEIK

SEQ ID NO: 5008 - protein, 100 aa, Artificial Sequence
  Description of Artificial Sequence: Synthetic polypeptide
MTQSPSSMSVSLGDTVSITCHASQDISGHIGWLQQKPGKSFKGLIYHGTNLEDGVPSRFSGSGSGADFSLTISSLESEDFADYYCVQYVQFPWTFGGGTK

SEQ ID NO: 5009 - protein, 113 aa, Artificial Sequence; identical to SEQ ID NO: 4824
  Description of Artificial Sequence: Synthetic polypeptide

SEQ ID NO: 5010 - protein, 122 aa, Artificial Sequence
  Description of Artificial Sequence: Synthetic polypeptide
  MOD_RES (122)..(122): Any amino acid
VLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGPVFGGGTKLTVLGNPKAAPSVTLFPX

SEQ ID NO: 5011 - protein, 128 aa, Artificial Sequence
  Description of Artificial Sequence: Synthetic polypeptide
  MOD_RES (125)..(125): Any amino acid
  MOD_RES (128)..(128): Any amino acid
LTQPPSVSGAPGQKVTISCTGSQSVSSNIGAGYDVHWYQQLPGTAPKLLIYGNSNRPSGVPDRFSGSKSGTSASLAITGLQAEDEADYHCQSYDSSLNGYYVFGTGTKVTVLGQPKANPTVTLFXPSX

SEQ ID NO: 5012 - protein, 121 aa, Artificial Sequence
  Description of Artificial Sequence: Synthetic polypeptide
VSAAPGQKPTISCSGSSSNIGTDYVSWQQLPGTAPKLIYDNNKRPSGMPDRFSSKSGTSATLGITGLQTGDEADYYGTWDSSLNGPVVFGGGTKLTVLGHHAAASVTLFLPSSPDVTIKIK

SEQ ID NO: 5013 - protein, 121 aa, Artificial Sequence [sequence omitted]

SEQ ID NO: 5014 - protein, 118 aa, Artificial Sequence [sequence omitted]

SEQ ID NO: 5015 - protein, 59 aa, Artificial Sequence
  Description of Artificial Sequence: Synthetic polypeptide
LTISKDTSKRQVVLSMTDMDPVDTATYYCARAPSEYAAMDVWGQGTMVTVSSYQGPSRE

SEQ ID NO: 5016 - protein, 116 aa, Artificial Sequence
  Description of Artificial Sequence: Synthetic polypeptide
SYVLTQPPSVSGTPGQRVIISCSGYSSNIGSNTVNWYQQFPGTAPRLLIYANNQRPPGVPDRFSGSKSGTSASLAISGLQSDDESDYYCAAWDDSLNGHWVFGGGTKVTVLRTVAS

SEQ ID NO: 5017 - protein, 108 aa, Artificial Sequence
  Description of Artificial Sequence: Synthetic polypeptide
EIVLTQSPGTLSLSPGERATLSCRASQSVSSSQLAWYQQKPGQAPRLIIYGASTRATGIPDRFSGSGSGTDFTLTIGRLEPEDFAVFFCQQYSTSPPTFGQGTKVDFK

SEQ ID NO: 5018 - protein, 109 aa, Artificial Sequence
  Description of Artificial Sequence: Synthetic polypeptide
EIILAQSPGTLSLSPGERATLSCRASQFVSTRSLAWYQQRPGQAPRLLIYGASSRATGIPDRFSGSGSGTDFTLTISRLEPEDFAVYYCQHYGYSPRYAFGQGSKVEIK

SEQ ID NO: 5019 - protein, 108 aa, Artificial Sequence
  Description of Artificial Sequence: Synthetic polypeptide
DIVLTQSPGTLSLSPGERATLSCRASQSVSSSYLAWYQQKPGQAPRLVMYGAATRATGIPDRFSGSGSGPDFTLTISRLEPEDFAMYYCQQYGNSPITFGQGTRLEIK

SEQ ID NO: 5020 - protein, 113 aa, Artificial Sequence
  Description of Artificial Sequence: Synthetic polypeptide
DIVMTQSPDFLPVSLGERATINCKSSQRVLYSSNNKNYLAWYQLKPGQPPKLIIYWASTRESGVPDRFSGSGSGTEFTLTISSLQAEDVAVYYCQQYYSRPYTFGQGTKLEIK

SEQ ID NO: 5021 - protein, 108 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSHWPPITFGQGTRLEIK

SEQ ID NO: 5022 - protein, 110 aa, Artificial Sequence
  Description of Artificial Sequence: Synthetic polypeptide
QSALTQPASVSGSPGQSITISCTGTSSDVGGYNYVSWYQQHPGKAPKLLIYEVTNWPSGVSNRFSGSKSGNTASLTISGLQAEDEADYYCSSYAGSSTWVFGGGTRVTVL

SEQ ID NO: 5023 - protein, 108 aa, Artificial Sequence
  Description of Artificial Sequence: Synthetic polypeptide
SYELTQPPSVSVSPGQTARITCSGDALPKQNAYWYQQKPGQAPVLLIYKDSERPSGIPERFSGSSSGTTVTLTISGVQAEDEADYYCQSADSSGTSWVFGGGTKLTVL

SEQ ID NO: 5024 - protein, 110 aa, Artificial Sequence
  Description of Artificial Sequence: Synthetic polypeptide
QTVVTQEPSLTVSPGGTVTLTCASSTGAVTSSYFPNWFQQKPGQAPRPLIYSTTIRHSWTPARFSGSLLGGKAALTLSGVQPEDEADYYCLLYSGGDPVAFGGGTKLTVL

SEQ ID NO: 5025 - protein, 106 aa, Artificial Sequence
  Description of Artificial Sequence: Synthetic polypeptide
SYVLTQPPSVSVAPGQTARISCGGSNIGGKSVHWYQQKPGQAPVLVVYDDSGRPSGIPERFSGSNSGDTATLTISRVEAGDEADYFCQVWDNFGGVFGTGTKVTVL

SEQ ID NO: 5026 - protein, 111 aa, Artificial Sequence
  Description of Artificial Sequence: Synthetic polypeptide
QSMLTQPPSASGTPGQRVTISCSGSSSNIGSNTVNWFKHLPGTAPKLLIYRNDLRPSGVPDRFSGSKSGTSASLAISGLQSEDEADYYCATWDDSLNGFYVFGTGTKVTVL

SEQ ID NO: 5027 - protein, 109 aa, Artificial Sequence
  Description of Artificial Sequence: Synthetic polypeptide
EIVLTQSPGTLSLSPGERATLSCRASHFVNYRSLAWYQQTPGQVPRLLIYGASTRATGIPDRFSGSGSGTDFTLTISRLEPEDFAVYFCQQYGGSPRYTFGQGTRLEIK

SEQ ID NO: 5028 - protein, 109 aa, Artificial Sequence
  Description of Artificial Sequence: Synthetic polypeptide
EIVLTQSPGTLSLSPGERATLSCRASHFVIGRAVAWYQQKPGQAPRLLIYGASSRATGIPDRFSGSGSGTDFTLTISRLETEDFAVFYCQHYGSSPRYAFGQGTKLEIK

SEQ ID NO: 5029 - protein, 107 aa, Artificial Sequence
  Description of Artificial Sequence: Synthetic polypeptide
DIQMTQSPSSLSASVGDRVTITCRASQSISSYLNWYQHKPGKAPKVLMYAVSILQSGVPSRFSGSGSGADFTLTISSLQPEDFATYYCQQSYSSPLTFGGGTKVEIK

SEQ ID NO: 5030 - protein, 113 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRISGSGSGADFTLTISSLQAEDVAVYYCQQYFATPRTFGQGTKVEIK

SEQ ID NO: 5031 - protein, 113 aa, Artificial Sequence
  Description of Artificial Sequence: Synthetic polypeptide
DIVMTQSPDSLAVSLGERATINCKSSQSVLYSSNNKSHLAWYQQKPGQPPKLLIYWASTRESGVPDRFSGSGSGTDFTLIISSLQAEDVAVYYCQQYYFSPLTFGGGTKVEIK

SEQ ID NO: 5032 - protein, 108 aa, Artificial Sequence
  Description of Artificial Sequence: Synthetic polypeptide
SYVLTQAPSVSVAPGQTARITCGGNAIGSKKVHWYQHKAGQAPVLVVYDDTDRPSGIPERFSGSNSWSTATLTINRVEAGDEADYYCQVWDFTIDHVVFGGGTKLTVL

SEQ ID NO: 5033 - protein, 110 aa, Artificial Sequence
  Description of Artificial Sequence: Synthetic polypeptide
QSVLTQSPSVSAAPGQKVTISCSGSDSNIGDYFVCWYQHLPGKPPQLLIYENNKRPSGIPDRFSGSKSGTSATLGITGIQTGDEADYYCATWDGSLSAWVFGGGTKLTVL

SEQ ID NO: 5034 - protein, 109 aa, Artificial Sequence
  Description of Artificial Sequence: Synthetic polypeptide
EIVLTQSPATLSLSPGERATLSCRASQSVGNYLAWYQQKPGQAPRLLIYDSSNRAPGIPARFSGSGSGTDFTLTISSLAPEDFAVYYCQQRSKWPPMYSFGHGTKLEIK

SEQ ID NO: 5035 - protein, 108 aa, Artificial Sequence
  Description of Artificial Sequence: Synthetic polypeptide
EIVLTQSPGTLSLSPGERATLSCRASQSVSSSYLAWYQKKPGQAPRLLIYGASTRATGIPDRFTGSGSGTDFTLSISRLEPEDFAVYYCQHFGTSVFTFGGGTKVEIK

SEQ ID NO: 5036 - protein, 113 aa, Artificial Sequence
  Description of Artificial Sequence: Synthetic polypeptide
DIVMTQSPDSLAVSLGERATINCRSSQSIFHNSNNENYLAWYQQKPGQPPKLLIYWASTRESGVPDRFSGSGSGTDFTLTISSLQAEDVAVYFCQQYYNAPLTFGGGTKVEIK

SEQ ID NO: 5037 - protein, 110 aa, Artificial Sequence
  Description of Artificial Sequence: Synthetic polypeptide
QSALTQPRSVSGSPGQSITISCTGGSSDIGASNSVSWYQQHPGKAPKLVIFDVTERPSGVPHRFSGSKSGNTASLTVSGLQPDDEADYFCCAYGGKYLVVFGGGTKVTVL

SEQ ID NO: 5038 - protein, 110 aa, Artificial Sequence
  Description of Artificial Sequence: Synthetic polypeptide
QSALTQPPSASGSPGQSVTISCTGSSSDVGGYDYVSWYQQHPGKAPKLLIYEVTKRPSGVPDRFSGSKSGNTASLTVSGLQAEDEADYYCSSYAGNYNHVFGPGTKVTVL

SEQ ID NO: 5039 - protein, 110 aa, Artificial Sequence
  Description of Artificial Sequence: Synthetic polypeptide
QAVVTQEPSLAVSPGGTVTLTCGSSTGAVTRGHYPYWFQQKPGQAPRALIYDSAGNRHSWTPARFSGSLLGGKAALTLSGAQPEDEAEYYCLLSYSGVWVFGGGTKLTVL

SEQ ID NO: 5040 - protein, 109 aa, Artificial Sequence
  Description of Artificial Sequence: Synthetic polypeptide
QAVVTQEPSLTVSPGGTVTLTCGSSTGPVTSGHYPYWFQQKPGQAPRTLISATSNTHSWTPARFSGSLLGGRAALTLSGAQPEDEADYYCFLSYSGAWVFGGGTTLTVL

SEQ ID NO: 5041 - protein, 107 aa, Artificial Sequence
  Description of Artificial Sequence: Synthetic polypeptide
DIQMTQSPSSLSASVGDRVTITCRASQNIKRYFNWYQQKPGKAPKLLIYAASNLENGVPSRFSGSGSGTDFTLTISSLQPEDFATYYCQQSFSKSWTFGQGTNVDIK

SEQ ID NO: 5042 - protein, 118 aa, Artificial Sequence
  Description of Artificial Sequence: Synthetic polypeptide
QPVLSQPPSASASLGASVTLTCTLSSGFDNYQVAWYQQRPGKGPRFVMRVGNGGNVASKGDGIPDRFSVSGSGLNRYLTIKNIQEDDESDYYCGADHGSGNNFVSPYVFGGGTKLTVL

SEQ ID NO: 5043 - protein, 101 aa, Artificial Sequence
  Description of Artificial Sequence: Synthetic polypeptide
QSALTQPASVSGSPGRSITISCSGTRSDVGGHNYVSWYQQHPGKAPKLMIYEVSHRPSGVSNRFSGSKSGSTASLTISGLQSEDEADYYCSSYTGEGPLGV

SEQ ID NO: 5044 - protein, 97 aa, Artificial Sequence
  Description of Artificial Sequence: Synthetic polypeptide
VLTQPPSVSVAPGQTARIACGGNNIGSKSVHWYQQKPGQAPVLVVYDDSARPSGIPERFSGSNSGNTATLTISRVEAGDEADYYCQVWESGSDLRLL

SEQ ID NO: 5045 - protein, 96 aa, Artificial Sequence
  Description of Artificial Sequence: Synthetic polypeptide
VLTQPPSVSVAPGQTAKITCGGDNIGRKSVHWYQQKPGLAPVLVVNDNSDRPSGIPARFSGSNSGNTATLTISRVEAGDEADYYCHVWGSSRDHYV

SEQ ID NO: 5046 - protein, 101 aa, Artificial Sequence
  Description of Artificial Sequence: Synthetic polypeptide
QSVVTQPPSVSGAPGQRVTISCTGSSSNIGAGYDVHWYQQLPGTAPKLLIYGNNNRPSGVPDRFSGSRSGPLALLAITGLQAEDEADYYCQSYDSSLSVYV

SEQ ID NO: 5047 - protein, 98 aa, Artificial Sequence
  Description of Artificial Sequence: Synthetic polypeptide
SSELTQDPAVSVALGQTVRITCQGDSLRSYYASWYQQKPGQAPVLVIYAKTNRPSGIPDRFSGSTSGNTASLTITGAQAEDEADYYCNSRDSSGNHVV

SEQ ID NO: 5048 - protein, 107 aa, Artificial Sequence; identical to SEQ ID NO: 4936
  Description of Artificial Sequence: Synthetic polypeptide

SEQ ID NO: 5049 - protein, 108 aa, Artificial Sequence
  Description of Artificial Sequence: Synthetic polypeptide
ETVLTQSPGTLSLTPGERATLSCRVGQSVSGSHLAWYQQKPGQAPRLLIYGASSRATGIPDRFGGSVSGTDFTLTISRLEPEDSAVYYCQQYGDSRYTFGQGTKLEIK

SEQ ID NO: 5050 - protein, 118 aa, Artificial Sequence
  Description of Artificial Sequence: Synthetic polypeptide
QPVLTQPPSASASLGASVTLTCTLSSAYSNYKVDWYQQRPGKGPRFVMRVGTGGIVGSKGDGIPDRFSVLGSGLNRYLTIKNIQEEDESDYHCGADHGSGSNFVSPYVFGGGTKLTVL

SEQ ID NO: 5051 - protein, 110 aa, Artificial Sequence
  Description of Artificial Sequence: Synthetic polypeptide
QSALTQPRSVSGSPGQSVTISCTGSSSDVGASNSVSWYQQHPGKAPKLVIYDVTERPSGVPHRFSGSKSGNTASLTVSGLQPEDEADYFCCAYGGKYLVVFGGGTKVTVL

SEQ ID NO: 5052 - protein, 107 aa, Artificial Sequence
  Description of Artificial Sequence: Synthetic polypeptide
DIQLTQSPSSLSASVGDRVTITCRASQSISRYLNWYQQKPGKAPKLLLFAASTLLDGVPSRFSGSGSGTDFTLTISSLQPEDFATYYCQRNHSPSWTFGQGTRVEIK

SEQ ID NO: 5053 - protein, 107 aa, Artificial Sequence
  Description of Artificial Sequence: Synthetic polypeptide
DIQMTQSPSSLSASVGDRVTMTCRASQNIRSYLNWYQQRPGTAPKLLIYAASTLHSGVPSRFSGGGSGTDFTLTINNLQPEDFASYYCQQSYDNPQTFGQGTKVEIK

SEQ ID NO: 5054 - protein, 107 aa, Artificial Sequence
  Description of Artificial Sequence: Synthetic polypeptide
DIQMTQSPSSLSASVGDRVTITCRANQDIGIYLNWYQQNPGKVPKLLLHGASSLQGGVPSRFSASGSGTDFTLTIHSLQPEDLATYYCQQSRRLPYTFGQGTRVELK

SEQ ID NO: 5055 - protein, 110 aa, Artificial Sequence
  Description of Artificial Sequence: Synthetic polypeptide
QSALTQPASVSGSPGQSITISCTGSSSDIGGYNYVSWYQQHPGKAPKLMIYDVNNRPSGVSNRFSGSKSGNTASLTISGLQTDDEADYYCGSYTGSPHYVFGTGTKVTVL

SEQ ID NO: 5056 - protein, 109 aa, Artificial Sequence
  Description of Artificial Sequence: Synthetic polypeptide
EIVMTQFPATLSVSPGERVTLSCRASQSVSNNLAWYQQKPGQPPRLLIYDASTRATGVPAKFSGTGSGTEFTLSISSLQSEDFAVYYCQQYHNWPPSYSFGLGTKLEIK

SEQ ID NO: 5057 - protein, 106 aa, Artificial Sequence
  Description of Artificial Sequence: Synthetic polypeptide
DIQLTQSPSSLSASVGDRVTITCRASQGILNCLAWYQQKPGKVPNLLMYAASTLQSGVPSRFSGSGFGTDFTLTISSLQPEDVATYYCQTYGGVSTFGGGTKVEIR

SEQ ID NO: 5058 - protein, 112 aa, Artificial Sequence
  Description of Artificial Sequence: Synthetic polypeptide
QSVLTQPPSVSGAPGQRVTISCTGSSSNIGSDYDVHWYKQLPGTAPKLLIFGNSNRPSGVPDRFSGSKSGTSASLAITGLQAEDEADYYCQSYDSSLSGFHVFGSGTKVTVL

SEQ ID NO: 5059 - protein, 107 aa, Artificial Sequence
  Description of Artificial Sequence: Synthetic polypeptide
DIQMTQSPSTLSASIGDRVTITCRASQSIASWLAWYQQKPGKAPKLLIYEAVNLESGVPSRFSGSGSGTDFTLTISSLQPDDFATYFCQHYGTISQTFGGGTKVEIK

SEQ ID NO: 5060 - protein, 108 aa, Artificial Sequence
  Description of Artificial Sequence: Synthetic polypeptide
EIVMTQSPATLSVSPGERATLSCRASQSVGNSLAWYQQRPGQAPRLLIYGASTRATGIPPRFSGSGSGTEFTLTISSLQTEDFAVYYCQQYINWRPLSFGGGTKVEIK

SEQ ID NO: 5061 - protein, 111 aa, Artificial Sequence
  Description of Artificial Sequence: Synthetic polypeptide
ETTLTQSPGTLSLSPGERATLSCRVSQSVSSNYLAWYQQKPGQAPRLLIYGASSRATGIPDRFSGSGSGTDFTLTISRLEPEDFAVYYCQQYGTSPRAFGHGTKVEIKRTV

SEQ ID NO: 5062 - protein, 110 aa, Artificial Sequence
  Description of Artificial Sequence: Synthetic polypeptide
ETTLTQSPATLSVSPGERATLSCRASQSVSRNLAWYQQKPGQAPRLLIYGASSRATGIPDRFSGSGSGTDFTLTISRLEPEDFAVYYCQQYGSSSITFGQGTRLEIKRTV

SEQ ID NO: 5063 - protein, 111 aa, Artificial Sequence
  Description of Artificial Sequence: Synthetic polypeptide
QSVLTQPPSVSGAPGQRVTISCGGSRSNIGAGYDVHWYQQFPGTAPKVVIYGNNNRPSGVPDRFSGSKSGTSASLAITGLQAEDEANYYCQSYDTNLGGSIFGGGTQVTVL

SEQ ID NO: 5064 - protein, 109 aa, Artificial Sequence
  Description of Artificial Sequence: Synthetic polypeptide
NFMLTQPHSVSESPGKTVTISCTGSGGNIARNYVQWYQQRPGSAPVTVILEDDKRPSGIPDRFSGSIDRSSNSASLTISGLRTEDEALYYCQSYDDSDLVVFGGGTKLT

SEQ ID NO: 5065 - protein, 111 aa, Artificial Sequence
  Description of Artificial Sequence: Synthetic polypeptide
NFMLTQPHSVSESPGKTVTISCTGSSGSIASNYVQWYQQRPGSAPTTVIYEDYQRPSGVPDRFSGSIDSSSNSASLTISGLKTEDEADYYCQSYDDSDHLIFGGGTKLTVL

SEQ ID NO: 5066 - protein, 110 aa, Artificial Sequence
  Description of Artificial Sequence: Synthetic polypeptide
QSVLTQPPSASGTPGQRVTISCSGSSSNIGSNTVNWYKQLPGTAPRLLIYSNDQRPSGVPDRFSGSKSGTSASLAISGLQSEDEANYYCAAWDDSLSGWVFGGGTKLTVL

SEQ ID NO: 5067 - protein, 107 aa, Artificial Sequence; identical to SEQ ID NO: 4825
  Description of Artificial Sequence: Synthetic polypeptide

SEQ ID NO: 5068 - protein, 107 aa, Artificial Sequence; identical to SEQ ID NO: 4826
  Description of Artificial Sequence: Synthetic polypeptide

SEQ ID NO: 5069 - protein, 112 aa, Artificial Sequence
  Description of Artificial Sequence: Synthetic polypeptide
QSVLTQPPSVSGAPGQRVTISCTGSSSNIGAGYDVHWYQQLPGTAPKLLIYDNNNRPSGVPDRFSGSKSGASASLAITGLQAEDEAHYYCQSYDNSLSGSVFGGGTQLTVLS

SEQ ID NO: 5070 - protein, 107 aa, Artificial Sequence
  Description of Artificial Sequence: Synthetic polypeptide
DIQLTQSPSSLSASVGDRVTLTCQASQDIRKFLNWYQQKPGKGPKLLIYDASNLQRGVPSRFSGGGSGTDFTLIISSLQPEDVGTYYCQQYDGLPFTFGGGTKLEIK

SEQ ID NO: 5071 - protein, 107 aa, Artificial Sequence
  Description of Artificial Sequence: Synthetic polypeptide
DIQLTQSPSSLSASIGDRVTITCQASQDIRNSLNWYEHKPGKAPKLLIHDASNLETGVPSRFSGGGSGTDFTLTISSLQPEDFATYYCQQANSFPLTFGGGTKVEIK

SEQ ID NO: 5072 - protein, 109 aa, Artificial Sequence
  Description of Artificial Sequence: Synthetic polypeptide
EIVMTQSPGTLSLSPGERATLSCRASQSVSSSYLAWYQQKPGQAPRLLIYGASTRATGVPDRFHGGGSGTDFTLTISRLEPEDFAVYYCQQYDTSSGLTFGGGTKVEIK

SEQ ID NO: 5073 - protein, 114 aa, Artificial Sequence
  Description of Artificial Sequence: Synthetic polypeptide
DIVMTQSQKFVSTSVGDRVSVTCKASQNVGSNVAWYQHKPGHSPTALIYSASHRYSGVPDRFTGSESGTDFTLTISNVQSEDLAEYFCQQYYSYPYTFGGGTKLEIKRADAAPT

SEQ ID NO: 5074 - protein, 114 aa, Artificial Sequence
  Description of Artificial Sequence: Synthetic polypeptide
DIVMTQSQKFMSTSVGDRVSVTCKASQNVDTYVAWYQQKPGQSPKALIYSASYRYSGVPDRFTGSGSGTDFTLTISNVQSEDLAEYFCQQYKTYPFTFGSGTKLEIKRADAAPT

SEQ ID NO: 5075 - protein, 106 aa, Artificial Sequence
  Description of Artificial Sequence: Synthetic polypeptide
DIQMTQSPSSLSASVGDRVTITCRTSQSISSYLNWYQQKPGKAPKLLIYAASSLQSGVPSRFSGSGSGTDFTLTISGLQPEDFATYYCQQSYSMPAFGQGTKLEIK

SEQ ID NO: 5076 - protein, 107 aa, Artificial Sequence; identical to SEQ ID NO: 4831
  Description of Artificial Sequence: Synthetic polypeptide

SEQ ID NO: 5077 - protein, 107 aa, Artificial Sequence; identical to SEQ ID NO: 4845
  Description of Artificial Sequence: Synthetic polypeptide

SEQ ID NO: 5078 - protein, 106 aa, Artificial Sequence; identical to SEQ ID NO: 4371
  Description of Artificial Sequence: Synthetic polypeptide

SEQ ID NO: 5079 - protein, 107 aa, Artificial Sequence; identical to SEQ ID NO: 4370
  Description of Artificial Sequence: Synthetic polypeptide

SEQ ID NO: 5080 - protein, 106 aa, Artificial Sequence; identical to SEQ ID NO: 4369
  Description of Artificial Sequence: Synthetic polypeptide

SEQ ID NO: 5081 - protein, 107 aa, Artificial Sequence; identical to SEQ ID NO: 4368
  Description of Artificial Sequence: Synthetic polypeptide

SEQ ID NO: 5082 - protein, 108 aa, Artificial Sequence
  Description of Artificial Sequence: Synthetic polypeptide
DIQMTQSPSSLSASVGDRVTITCRASQSISTYLNWYQQKPGKAPKLLIYAASSLHSGVPSRFSGSGSGTDFALTISSLQPEDFATYYCQQSYSPPITFGQGTRLEIKR

SEQ ID NO: 5083 - protein, 108 aa, Artificial Sequence
  Description of Artificial Sequence: Synthetic polypeptide
DIQMTQSPSSLSASVGDRVTITCRASQSISNYLNWYQHKPGEAPKLLNYAASSLQSGVPSRFSASGSGTDFTLSISGLQPEDFATYYCQQSYNTPITFGPGTRLEIKR

SEQ ID NO: 5084 - protein, 108 aa, Artificial Sequence
  Description of Artificial Sequence: Synthetic polypeptide
DIQMTQSPSSLSASVGDRVTITCRASQSISNYLNWYQHKPGEAPKLLNYAASSLQSGVPSRFSASGSGTDFTLTISSLQPEDFATYYCQQSYNTPITFGQGTRLEIKR

SEQ ID NO: 5085 - protein, 108 aa, Artificial Sequence
  Description of Artificial Sequence: Synthetic polypeptide
DIQMTQSPSSLSASVGDRLTITCRASQSISTYLHWYQQKPGKAPKLLIYAASSLQSGVPSRFSGSRSGTDFTLTISSLQPDDFATYYCQQSYSPPLTFGPGTKVDMKR

SEQ ID NO: 5086 - protein, 107 aa, Artificial Sequence
  Description of Artificial Sequence: Synthetic polypeptide
DIQMTQSPSSLSASVGDRVTITCRASQSISTYLNWYQKRPGKAPKLLVYGASSLQSGVPSRFSGSGSGTDFTLTIASLQPEDSAVYYCQQTYSIPLFGQGTRLEIKR

SEQ ID NO: 5087 - protein, 107 aa, Artificial Sequence
  Description of Artificial Sequence: Synthetic polypeptide
DIQMTQSPSSLSASVGDRVTITCRASQSISTYLNWYQKRPGKAPKLLVYGASTLQSGVPSRFSGSGSGTDFTLTIASLQPEDSATYYCQQTYSIPLFGQGTRLEIKR

SEQ ID NO: 5088 - protein, 107 aa, Artificial Sequence
  Description of Artificial Sequence: Synthetic polypeptide
DIQMTQSPLSVSVSVGDRVTIACRASQSIDKFLNWYQQKPGKAPKLLIYGASNLHSGAPSRFSASGSGTDFTLTITNIQTEDFATYLCQQSFSVPAFGGGTKVEIKR

SEQ ID NO: 5089 - protein, 108 aa, Artificial Sequence
  Description of Artificial Sequence: Synthetic polypeptide
DIQMTQSPSSLSASVGDRVTISCRASQSISTYLNWYQQQPGKAPKVLISGATNLQSGVPSRFSGSGSGTDFTLTISSLQPEDFATYYCQQSYNTPLIFGQGTKLEIKR

SEQ ID NO: 5090 - protein, 108 aa, Artificial Sequence
  Description of Artificial Sequence: Synthetic polypeptide
DIQMTQSPSSLSASVGDRVTISCRASQSISTYLNWYQQQPGKAPKVLIFGATNLQSGVPSRFSGSGSGTDFTLTISSLQPEDFATYYCQQSYNTPLIFGQGTKLEIKR

SEQ ID NO: 5091 - protein, 108 aa, Artificial Sequence
  Description of Artificial Sequence: Synthetic polypeptide
DIQMTQSPSSLSSSVGDRVTITCRASQSIGAYVNWYQQKAGKAPQVLIFGASNLQSGVPSRFSGSGSGTDFTLTISSLQPEDFATYFCQQTYSTPITFGQGTRLEIKR

SEQ ID NO: 5092 - protein, 112 aa, Artificial Sequence
  Description of Artificial Sequence: Synthetic polypeptide
QSVLTQPPSVSGAPGQRVTISCTGGSSNIGAGYSVHWYQQLPGTAPKLLIYGSNSRPSGVPDRFSGSKSGTSASLAITGLRPEDEADYYCQSYDSSLSGSQVFGAGTRVTVL

SEQ ID NO: 5093 - protein, 211 aa, Artificial Sequence
  Description of Artificial Sequence: Synthetic polypeptide
QSVLTQPPSVSVAPGQTARITCGGNDIGRKSVHWNQQKPGQAPVLVVCYDSDRPSGIPERFSGSNSGNTATLTISRVEAGDEADYYCQVWDSSSDHVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPT

SEQ ID NO: 5094 - protein, 109 aa, Artificial Sequence
  Description of Artificial Sequence: Synthetic polypeptide
DIRLTQSPATLSVSPGERATLSCRASHSVSRNLAWYQQKPGRAPRLLVYDTSSRATGIPARFSGSGSGTEFTLTISSLQSEDFAVYYCQQYNNWPRTFGQGTKVDIKRT

SEQ ID NO: 5095 - protein, 217 aa, Artificial Sequence
  Description of Artificial Sequence: Synthetic polypeptide
SYVLTQPPSVSGTPGQRVIISCSGYSSNIGSNTVNWYQQFPGTAPRLLIYANNQRPPGVPDRFSGSKSGTSASLAISGLQSDDESDYYCAAWDDSLNGHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 5096 - protein, 226 aa, Artificial Sequence
  Description of Artificial Sequence: Synthetic polypeptide
QVQLVQSGAEVKKPGASVKVSCKTSGYSFSTYGVSWVRQAPGQGPEWVGWISAYTGITDYAQKFQGRVTLTTDATTATAFLDLRSLRPDDTATYFCARDKVQGRVEVGSGGRHDYWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 5097 - protein, 215 aa, Artificial Sequence; identical to SEQ ID NO: 4647
  Description of Artificial Sequence: Synthetic polypeptide

SEQ ID NO: 5098 - protein, 120 aa, Artificial Sequence
  Description of Artificial Sequence: Synthetic polypeptide
QVQLQQPGVELVRPGASVKLSCKASGYTFTSFWMNWVKQRPDQGLEWIGRIDPYDSETHYNQKFKDKAILTVDKSSSTAYMQLSSLTSEDSAVYYCGRGIATLMVLPDYWGQGTSVTVSS

SEQ ID NO: 5099 - protein, 368 aa, Artificial Sequence
  Description of Artificial Sequence: Synthetic polypeptide
CAGGTTCAGCTGCAGCAGTCTGGAGCTGAGCTGATGAAGCCTGGGGCCTCAGTGAAGATATCCTGCAAGGCTACTGGCTACACATTCAGTGGGCACTGGATAGAGTGGGTAAAGCAGAGGCCTGGACATGGCCTTGAGTGGATTGGAGAGATTTTACCTGGAAGTGGTAATATTCACTATAATGAGAAGTTTAAGGGCAAGGCCACATTCGCTGCAGATACATCCTCCAACACAGCCTACATGCAACTCAGCAGCCTGACATCTGAGGACTCTGCCGTCTATTACTGTGCAAGATTGGGTACTACGGCAGTAGAGAGGGACTGGTACTTCGATGTCTGGGGCCAAGGAACCCTGGTGACCGTGTCCTC

SEQ ID NO: 5100 - protein, 123 aa, Artificial Sequence; identical to SEQ ID NO: 4347
  Description of Artificial Sequence: Synthetic polypeptide

SEQ ID NO: 5101 - protein, 118 aa, Artificial Sequence
  Description of Artificial Sequence: Synthetic polypeptide
EVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGQVTVSS

SEQ ID NO: 5102 - protein, 121 aa, Artificial Sequence
  Description of Artificial Sequence: Synthetic polypeptide
EVQLVESGGGLVQPGGSLRLSCAASGFTFSSYAMGWVRRAPGEGLEWVSSISSGGALPTYADSVKGRFTISRDNVKNTLYLQMNSLKPEDTAVYSCEKYAGSMWTSERDAWGQGTQVTVSS

SEQ ID NO: 5103 - protein, 119 aa, Artificial Sequence
  Description of Artificial Sequence: Synthetic polypeptide
EVQLVESGGGLVQPGGSLRLSCTGSGFTFSSYWMDWVRQTPGKDLEYVSGISPSGGNTDYADSVKGRFTISRDNAKNTLYLQMNSLQPEDTALYYCRRSLTLTDSPDLRSQGTQVTVSS

SEQ ID NO: 5104 - protein, 252 aa, Artificial Sequence
  Description of Artificial Sequence: Synthetic polypeptide
MAAVTLDESGGGLQTPGGGLSLVCKASGFIFSDRGMHWVRQAPGKGLEWVGGIGSSGSSTWYGAAVKGRATISRDNGQSTVRLQLNNLRAEDTGTYYCAKDASSGGGGSPYGVARIDAWGHGTEVMVSSGSASAPKLEEGEFSEARVALTQPSSVSANLGGTVEITCSGGGGSYGWYQQKSPGSAPVTVIYYNDKRPSDIPSRFSGSASGSTATLTITGVQVGDEAVYYCASADSSAAAFGAGTTLTVLGAA

SEQ ID NO: 5105 - protein, 252 aa, Artificial Sequence
  Description of Artificial Sequence: Synthetic polypeptide
MAAVTLDESGGGLQTPGGALSLVCKASGFIFSDRGMHWVRQAPGKGLEWVGGIGSSGSSTWYGAAVKGRATISRDNGQSTVRLQLNNLRAEDTGTYYCAKDASSGGGGSPYGVARIDAWGHGTEVMVSSGSASAPKLEEGEFSEARVALTQPSSVSANLGGTVEITCSGSWGSYGWYQQRAPGSAPVTVIYETTKRPSNIPSRFSGSKSGSTHTLTITGVQAEDEAVYYCGSADSSVGIFGAGTTLTVLAAA

SEQ ID NO: 5106 - protein, 259 aa, Artificial Sequence
  Description of Artificial Sequence: Synthetic polypeptide
MAAVTLDESGGGLQTPGGALSLVCKASGFSISGYNMNWVRQAPGKGLEWVAEISDDGSYTYYGAAVKGRATISRDNGQSTVRLQLNNLRAEDTGIYYCAKSAGNAGGSGYSYTGLIDAWGHGTEVMVSSGSASAPKLEEGEFSEARVALTQPSSVSANPGETVKITCSGGGSYAGSYYYGWYQQKSPGSAPVTVIYSNDKRPSDIPSRFSGALSGSTATLTITGVQADDEAVYFCGSADSSNSAGIFGAGTTLTVLGAA

SEQ ID NO: 5107 - protein, 252 aa, Artificial Sequence
  Description of Artificial Sequence: Synthetic polypeptide
MAAVTLDESGGGLRTPGGALSLVCKASGFTFSDRGMHWVRQAPGKGLEWVGGIGSSGSSTWYATAVKGRATISRNNGQSTVRLQLNSLRAEDTGTYYCAKDASSGGGGSPYGVARIDAWGHGTEVMVSSGSASAPKLEEGEFSEARVALTQPSSVSANPGGTVKITCSGSSGSYGWYQQKSPGSAPVTVIYYNDKRPSDIPSRFSGSKSGSTGTLTITGVQAEDEAVYYCGNADSSSTALFGAGTTLTVLAA

SEQ ID NO: 5108 - protein, 252 aa, Artificial Sequence
  Description of Artificial Sequence: Synthetic polypeptide
MAAVTLDESGGGLQTPGGALSLVCKASGFIFSDRGMHWVRQAPGKGLEWVGGIGSSGSSTWYATAVKGRATISRDNGQSTVRLQLNNLRAEDTGTYYCAKDASSGGGGSPYGVARIDAWGHGTEVMVSSGSASAPKLEEGEFSEARVALTQPSSVSANPGETVEITCSGSSGRYGWYQQKSPGSAPVTLIYSNDKRPSDIPSRFSGSASGSTNTLTITGVQVEDEAVYFCGSYDGNSDVFGAGTTLTVLAAA

SEQ ID NO: 5109 - protein, 249 aa, Artificial Sequence
  Description of Artificial Sequence: Synthetic polypeptide
MAAVTLDESGGGLQTPGGALSLVCKGSGFSVGSYAMFWVRQAPGKGLEYVAGIENDGSSTWYATAVKGRATISRDNGQSTVRLQLNNLRAEDTGTYYCARGDGPDSFDAWGHGTEVMVSSGSASAPKLEEGEFSEARVALTQPSSVSANPGETVKITCSGGSSYAGSYYYGWYQQKSPGSAPVTVIYSNNQRPSDIPSRFSGSTSGSTSTLTITGVQADDEAVYHCGAYDSTYLGIFGAGTTLTVLAAA

SEQ ID NO: 5110 - protein, 254 aa, Artificial Sequence
  Description of Artificial Sequence: Synthetic polypeptide
MAAVTLDESGGGLQTPGGGFSLVCKASGFTFSSYAMMWVRQAPGKRLEWVAGISGAGSYTNYGAAVKGRATISRDNGQSTARLQLNNLRAEDTGTYFCARSSGYCGFSCAEYIDAWGHGTEVMVSSGSASAPKLEEGEFSEARVALTQPSSVSANLGGTVKITCSGGGSYYGWYQQKAPNSAPVSVIYDNTNRPSNIPSRFSGSKSGSTATLTITGVQADDEAVYFCGSYDSSTDSGYVGIFGAGTTLTVLGAA

SEQ ID NO: 5111 - protein, 252 aa, Artificial Sequence
  Description of Artificial Sequence: Synthetic polypeptide
MAAVTLDESGGGLQKPGGGLSLVCKASGFPFSSYSMQWVRQAPGKGLEWVAGIGNAGSYTGYGAAVKGRATISRDNGQSTVRLQLNNLRAEDTGTYYCAKSAYAGSCAGCVDSIDAWGHGTEVMVSSGSASAPKLEEGEFSEARVALTQPSSVSANPGETVKITCSGDDSWYGWYQQKSPGSAPVTVIYYNNNRPSDIPLRFSGSTSGSTSTLTITGVQADDEAVYFCGSWDRSSGAGIFGAGTTLTVLGAA

SEQ ID NO: 5112 - protein, 269 aa, Artificial Sequence
  Description of Artificial Sequence: Synthetic polypeptide
QSVLTQPLSAPGTPGQRVTISCSGSSSNVGTNAVDWYQRLPGTAPKLLIYYNNQRPSGVPDRFSGSKSGTSASLAISGLRSEDEADYYCATWDNSLNDRVFGGGTKLTVLGGGGGGSGGGGSGGGGSQVQLVQSGAEVRKPGSSVKVSCKASRGTFSNHAVSWVRQAPGHGLEWLGGLIPIFSTPHYAQKFQGRVTITADESTNTVHMELSSLRSEDTAVYYCAREIPGATSGPDHFFFYGMDVWGQGTTVAVSSASGSSGSGHHHHHH

SEQ ID NO: 5113 - protein, 238 aa, Artificial Sequence
  Description of Artificial Sequence: Synthetic polypeptide
RVQLVESGGGLVQPGGSLRLSCAASGFTFSSYAMSWVRQAPGKGLEWVSAISGSGGSTYYADSVKGRFTISRDNTKNTLYLQMNSLRAEDTAVYYCAKIVPKRVFDYWGQGTLVTVSRGGGGSGGGGSGGGGSSELTQDPAVSVALGQTVRITCQGDGLRSYYASWYQQKPGQAPVLVIYGKNNRPSGIPDRFSGSSSGNTASLTITGAQAEDEADYYCNSSQPPFGSVVFGGGTKLT

SEQ ID NO: 5114 - protein, 239 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRKRGFDYWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSSPSPLLGVVFGGGTKLTVLG

SEQ ID NO: 5115 - protein, 238 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKHGTRRAFDYWGQGTLVTVSRGGGGSGGGGSGGGGSSELTQDPAVSVALGQTVRITCQGDSLRSYYASWYQQRPGQAPVLVIYGKNNRPSGIPDRFSGSSSGNTASLTITGAQAEDEADYYCNSSEPPMAGVVFGGGTKLT

SEQ ID NO: 5116 - protein, 244 aa, Artificial Sequence
  Description of Artificial Sequence: Synthetic polypeptide
EVQLLESGGGLVQPGGSLRLSCAASGFTFGSYAMSWVRQAPGKGLEWVSAISGSGGSTYYADSVKGRFTISRDNSKNTLYLQMNSLRAEDTAVYYCAKPTHAGTFDYWGQGTLVTVSRGGGGSGGGGSGGGGSSELTQDPAVSVALGQTVRITCQGDSLRSYYASWYQQKPGQAPVLVIYGKNNRPSGIPDRFSGSSSGNTASLTITGAQAEDEADYYCNSSPPLPVYVVFGGGTKLTVLGAAA

SEQ ID NO: 5117 - protein, 179 aa, Artificial Sequence
  Description of Artificial Sequence: Synthetic polypeptide
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKRQTLAFDYWGQGTLVTVSRGGGGSGGGGSGGGGSSELTQDPAVSVALGQTVRITCQGDSLRSYYASWYQQRPGQAPVLVIY

SEQ ID NO: 5118 - protein, 115 aa, Artificial Sequence; identical to SEQ ID NO: 4336
  Description of Artificial Sequence: Synthetic polypeptide

SEQ ID NO: 5119 - protein, 121 aa, Artificial Sequence [sequence omitted]

SEQ ID NO: 5120 - protein, 121 aa, Artificial Sequence
  Description of Artificial Sequence: Synthetic polypeptide
QVQLVQSGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSS

SEQ ID NO: 5121 - protein, 121 aa, Artificial Sequence [sequence omitted]

SEQ ID NO: 5122 - protein, 121 aa, Artificial Sequence [sequence omitted]

SEQ ID NO: 5123 - protein, 120 aa, Artificial Sequence
  Description of Artificial Sequence: Synthetic polypeptide
QVQLQQSGAEVKKPGSSVKVSCKVSGVIFSGSAISWVRQAPGQGLEWMGGISPLFGTTNYAQKFQGRVTITADQSTNTTYMEVNSLRYEDTAVYFCARGPKYYSEYMDVWGKGTTVTVSS

SEQ ID NO: 5124 - protein, 120 aa, Artificial Sequence
  Description of Artificial Sequence: Synthetic polypeptide
QVQLVQSGAEVKKPGSSVKVSCKASGGTFSSYAISWVRQAPGQGLEWMGGIMGMFGTTNYAQKFQGRVTITADEFTSAAYMELRSLRSEDTAVYYCARSSGYYPEYFQDWGQGTLVTVSS

SEQ ID NO: 5125 - protein, 120 aa, Artificial Sequence
  Description of Artificial Sequence: Synthetic polypeptide
QMQLVQSGAEVKKPGSSVKVSCKASGGTFSSYAITWVRQAPGQGLEWMGGIIGMFGSTNYAQNFQGRVTITADESTSTAYMELSSLRSEDTAVYYCARSTGYYPAYLHHWGQGTLVTVSS

SEQ ID NO: 5126 - protein, 121 aa, Artificial Sequence
  Description of Artificial Sequence: Synthetic polypeptide
EVQLVETGAEVKKPGASVKVSCKASGYTFTSYYMHWVRQAPGQGLEWMGWINPNSGGTNYAQKFQGRVTMTRDTSISTAYMELSRLRSDDTAVYYCAREGKWGPQAAFDIWGQGTMVTVSS

SEQ ID NO: 5127 - protein, 117 aa, Artificial Sequence
  Description of Artificial Sequence: Synthetic polypeptide
EVQLVESGGGLVQPGGSLRLSCAASGFTFSIYAMSWVRQAPGKGLEWVSAISSSGDSTYYADSVKGRFTISRDNARNTLYLQMNSLRAEDTAVYYCARAYGYTFDPWGQGTLVTVSS

SEQ ID NO: 5128 - protein, 122 aa, Artificial Sequence
  Description of Artificial Sequence: Synthetic polypeptide
QVQLVQSGGGLVKPGGSLRLSCAASGFTFSSYSMNWVRQAPGKGLEWVSSISSSSSYIYYVDSVKGRFTISRDNAKNSLYLQMNSLRAEDTAVYYCARGGGSYGAYEGFDYWGQGTLVTVSS

SEQ ID NO: 5129 - protein, 121 aa, Artificial Sequence [sequence omitted]

SEQ ID NO: 5130 - protein, 121 aa, Artificial Sequence [sequence omitted]

SEQ ID NO: 5131 - protein, 120 aa, Artificial Sequence
  Description of Artificial Sequence: Synthetic polypeptide
EVQLVESGAEVKKPGSSVKVSCKASGGTFSSYGISWVRQAPGQGLEWMGDIIGMFGSTNYAQNFQGRLTITADESTSTAYMELSSLRSEDTAVYYCARSSGYYPAYLPHWGQGTLVTVSS

SEQ ID NO: 5132 - protein, 121 aa, Artificial Sequence
  Description of Artificial Sequence: Synthetic polypeptide
EVQLVESGAEVKKPGSSVKVSCKASGGTFSFYSMSWVRQAPGQGLEWMGGIIPMFGTTNYAQKFQGRVTITAVESTSTAYMEVSSLRSEDTAVYYCARGDKGIYYYYMDVWGKGTTVTVSS

SEQ ID NO: 5133 - protein, 121 aa, Artificial Sequence
  Description of Artificial Sequence: Synthetic polypeptide
EVQLVETGAEVKKPGSSVKVSCKASGGTFRTHAISWVRQAPGQGLEWMGGIIAIFGTANYAQKFQGRITITADESTSTAYMELSSLRSEDTAVYFCARGSGYHISTPFDNWGQGTLVTVSS

SEQ ID NO: 5134 - protein, 128 aa, Artificial Sequence
  Description of Artificial Sequence: Synthetic polypeptide
EVALVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSS

SEQ ID NO: 5135 - protein, 121 aa, Artificial Sequence
  Description of Artificial Sequence: Synthetic polypeptide
EVQLVQSGAEVKKPGSSVKVSCKASGGIFRSNSISWVRQAPGQGLEWMGGIFALFGTTDYAQKFQGRVTITADESSTTVYLELSSLTSEDTAVYYCARGSGYTTRNYFDYWGQGTLVTVSS

SEQ ID NO: 5136 - protein, 120 aa, Artificial Sequence
  Description of Artificial Sequence: Synthetic polypeptide
EVQLVESGAEVKKPGSSVKVSCKASGGTFSSYAISWVRQAPGQGLEWMGGIIGMFGTANYAQKFQGRVTITADEFTSTAYMELSSLRSEDTAVYYCARGNYYYESSLDYWGQGTLVTVSS

SEQ ID NO: 5137 - protein, 120 aa, Artificial Sequence
  Description of Artificial Sequence: Synthetic polypeptide
QVQLVQSGAEVKKPGSSVKVSCKASGGPFRNFAINWVRQAPGQGLEWMGGIIAVFGTTKYAHKFQGRVTITADDSTNTAYMELGSLKSEDTAVYYCARGPHYYSSYMDVWGEGTTVTVSS

SEQ ID NO: 5138 - protein, 120 aa, Artificial Sequence
  Description of Artificial Sequence: Synthetic polypeptide
EVALVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSS

SEQ ID NO: 5139 - protein, 120 aa, Artificial Sequence
  Description of Artificial Sequence: Synthetic polypeptide
QMQLVQSGAEVKKPGSSVKVSCKASGGTFSSYAISWVRQAPGQGLEWMGGIFGMFGTANYAQKFQGRVTITADEFTSAAYMELSSLGSEDTAMYYCARSSGYYPQYFQDWGQGTLVTVSS

SEQ ID NO: 5140 - protein, 121 aa, Artificial Sequence
  Description of Artificial Sequence: Synthetic polypeptide
EVQLVESGAEVKKPGSSVKVSCKASGGIFNSYAISWVRQAPGQGLEWMGGIIAIFHTPKYAQKFQGRVTITADESTNTAYMELRSLKSEDTALYYCARGSTYDFSSGLDYWGQGTLVTVSS

SEQ ID NO: 5141 - protein, 126 aa, Artificial Sequence
  Description of Artificial Sequence: Synthetic polypeptide
QVQLVQSGAEVKKPGSSVKVSCKASGGFFSSYAISWVRQAPGQGLEWMGGVIPIFRTANYAQNFQGRVTITADEFTSYMELSSLRSDDTAVYYCARLNYHDSGTYYNAPRGWFDPWGQGTLVTVSS

SEQ ID NO: 5142 - protein, 120 aa, Artificial Sequence
  Description of Artificial Sequence: Synthetic polypeptide
QVQLVQSGAEVKKPGSSVKVSCKASGVTFSYYAMSWVRQAPGQGLEWMGGISPMFGTTTYAQKFQGRVTITADDSTSTAYMEVRSLRSEDTAVYYCARSSNYYDSVYDYWGQGTLVTVSS

SEQ ID NO: 5143 - protein, 123 aa, Artificial Sequence
  Description of Artificial Sequence: Synthetic polypeptide
QVQLVQSGAEVKKPGSSVRVSCKASGSIFRNYAMSWVRQAPGQGLEWMGGIIAIFGTPKYAQKFQGRVTITADESTSTVYMELSGLRSEDTAMYYCARIPHYNFGSGSYFDYWGQGTLVTVSS

SEQ ID NO: 5144 - protein, 121 aa, Artificial Sequence [sequence omitted]

SEQ ID NO: 5145 - protein, 121 aa, Artificial Sequence; identical to SEQ ID NO: 5120
  Description of Artificial Sequence: Synthetic polypeptide

SEQ ID NO: 5146 - protein, 121 aa, Artificial Sequence [sequence omitted]

SEQ ID NO: 5147 - protein, 121 aa, Artificial Sequence [sequence omitted]

SEQ ID NO: 5148 - protein, 120 aa, Artificial Sequence; identical to SEQ ID NO: 5123
  Description of Artificial Sequence: Synthetic polypeptide

SEQ ID NO: 5149 - protein, 120 aa, Artificial Sequence; identical to SEQ ID NO: 5124
  Description of Artificial Sequence: Synthetic polypeptide

SEQ ID NO: 5150 - protein, 120 aa, Artificial Sequence; identical to SEQ ID NO: 5125
  Description of Artificial Sequence: Synthetic polypeptide

SEQ ID NO: 5151 - protein, 121 aa, Artificial Sequence; identical to SEQ ID NO: 5126
  Description of Artificial Sequence: Synthetic polypeptide

SEQ ID NO: 5152 - protein, 117 aa, Artificial Sequence; identical to SEQ ID NO: 5127
  Description of Artificial Sequence: Synthetic polypeptide

SEQ ID NO: 5153 - protein, 122 aa, Artificial Sequence; identical to SEQ ID NO: 5128
  Description of Artificial Sequence: Synthetic polypeptide

SEQ ID NO: 5154 - protein, 121 aa, Artificial Sequence [sequence omitted]

SEQ ID NO: 5155 - protein, 121 aa, Artificial Sequence [sequence omitted]

SEQ ID NO: 5156 - protein, 120 aa, Artificial Sequence; identical to SEQ ID NO: 5131
  Description of Artificial Sequence: Synthetic polypeptide

SEQ ID NO: 5157 - protein, 121 aa, Artificial Sequence; identical to SEQ ID NO: 5132
  Description of Artificial Sequence: Synthetic polypeptide

SEQ ID NO: 5158 - protein, 121 aa, Artificial Sequence; identical to SEQ ID NO: 5133
  Description of Artificial Sequence: Synthetic polypeptide

SEQ ID NO: 5159 - protein, 128 aa, Artificial Sequence
  Description of Artificial Sequence: Synthetic polypeptide
EVQLVESGAEVKKPGSSVKVSCKASGHIFSGYAISWVRQAPGQGLEWMGGIIPIFGTTNYAQKFQGRVTITADQSTSTAYMDLSNLRSEDTAVYYCARVKDGYCTLTSCPVGWYFDLWGRGTLVTVSS

SEQ ID NO: 5160 - protein, 121 aa, Artificial Sequence; identical to SEQ ID NO: 5135
  Description of Artificial Sequence: Synthetic polypeptide

SEQ ID NO: 5161 - protein, 120 aa, Artificial Sequence; identical to SEQ ID NO: 5136
  Description of Artificial Sequence: Synthetic polypeptide

SEQ ID NO: 5162 - protein, 120 aa, Artificial Sequence; identical to SEQ ID NO: 5137
  Description of Artificial Sequence: Synthetic polypeptide

SEQ ID NO: 5163 - protein, 120 aa, Artificial Sequence
  Description of Artificial Sequence: Synthetic polypeptide
EVQLVETGAEVKKPGSSVKVPCKSSGSPFRSNAVSWVRQAPGQGLEWVGGILGVFGSPSYAQKFQGRVTITADESTNTVHMELRGLRSEDTAVYYCARGPTYYYSYMDVWGKGTTVTVSS

SEQ ID NO: 5164 - protein, 120 aa, Artificial Sequence; identical to SEQ ID NO: 5139
  Description of Artificial Sequence: Synthetic polypeptide

SEQ ID NO: 5165 - protein, 121 aa, Artificial Sequence; identical to SEQ ID NO: 5140
  Description of Artificial Sequence: Synthetic polypeptide

SEQ ID NO: 5166 - protein, 126 aa, Artificial Sequence; identical to SEQ ID NO: 5141
  Description of Artificial Sequence: Synthetic polypeptide

SEQ ID NO: 5167 - protein, 120 aa, Artificial Sequence; identical to SEQ ID NO: 5142
  Description of Artificial Sequence: Synthetic polypeptide

SEQ ID NO: 5168 - protein, 123 aa, Artificial Sequence; identical to SEQ ID NO: 5143
  Description of Artificial Sequence: Synthetic polypeptide

SEQ ID NO: 5169 - protein, 114 aa, Artificial Sequence
  Description of Artificial Sequence: Synthetic polypeptide
DVVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPLTFGGGTKVDIKR

SEQ ID NO: 5170 - protein, 111 aa, Artificial Sequence
  Description of Artificial Sequence: Synthetic polypeptide
SYVLTQPPSASGTPGQRVTISCSGSTFNIGSNAVDWYRQLPGTAPKLLIYSNNQRPSGVPDRFSGSRSGTSASLAISGLQSEDEADYYCAAWDDILNVPVFGGGTKLTVLG

SEQ ID NO: 5171 - protein, 111 aa, Artificial Sequence
  Description of Artificial Sequence: Synthetic polypeptide
QSALTQPAAVSGSPGQSITISCTGTSSDVGGYNYVSWYQQHPGKAPKLMIYEVSNRPSGVSNRFSGSKSGNTASLTISGLQAEDEADYYCSSYTSSSTYVFGTGTKVTVLG

SEQ ID NO: 5172 - protein, 111 aa, Artificial Sequence
  Description of Artificial Sequence: Synthetic polypeptide
SYVLTQPPSVSGTPGQRVTISCSGSRSNVGDNSVYWYQHVPEMAPKLLVYKNTQRPSGVPARFSGSKSGTSASLAIIGLQSGDEADYYCVAWDDSVDGYVFGSGTKVTVLG

SEQ ID NO: 5173 - protein, 111 aa, Artificial Sequence
  Description of Artificial Sequence: Synthetic polypeptide
SVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 5174 - protein, 109 aa, Artificial Sequence
  Description of Artificial Sequence: Synthetic polypeptide
DIQMTQSPSSLSASVGDRVTITCRASQGISSYLAWYQQKPGKVPTLLIYDASTLRSGVPSRFSGSGSATDFTLTISSLQPEDVATYYCQRYNSAPPITFGQGTRLEIKR

SEQ ID NO: 5175 - protein, 107 aa, Artificial Sequence
  Description of Artificial Sequence: Synthetic polypeptide
QSVLTQPPSESVSPGQTASVTCSGHKLGDKYVSWYQQKPGQSPVLLIYQDNRRPSGIPERFIGSNSGNTATLTISGTQALDEADYYCQAWDSSTAVFGGGTKLTVLG

SEQ ID NO: 5176 - protein, 111 aa, Artificial Sequence
  Description of Artificial Sequence: Synthetic polypeptide
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 5177 - protein, 109 aa, Artificial Sequence
  Description of Artificial Sequence: Synthetic polypeptide
EIVMTQSPGTLSLSPGERATLSCRASQSVSSSYLAWYQQKPGQAPRLLIYDASSRATDIPDRFSGSGSGTDFTLTISRLEPEDFAVYYCQQYGSSLWTFGQGTKVEIKR

SEQ ID NO: 5178 - protein, 113 aa, Artificial Sequence
  Description of Artificial Sequence: Synthetic polypeptide
EIVLTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKR

SEQ ID NO: 5179 - protein, 108 aa, Artificial Sequence
  Description of Artificial Sequence: Synthetic polypeptide
EIVLTQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 5180 - protein, 109 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHAVFGGGTQLTVLG

SEQ ID NO: 5181 - protein, 111 aa, Artificial Sequence
  Description of Artificial Sequence: Synthetic polypeptide
SYVLTQPPSASGTPGQRVTISCSGSSSNIGSNYVYWYQQLPGTAPKLLIYRDGQRPSGVPDRFSGSKSGTSASLAISGLRSDDEADYYCATWDDNLSGPVFGGGTKLTVLG

SEQ ID NO: 5182 - protein, 109 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRTFGGGTKVEIKR

SEQ ID NO: 5183 - protein, 111 aa, Artificial Sequence
  Description of Artificial Sequence: Synthetic polypeptide
QSALTQPASVSGSPGQSITISCTGTSSDVGGYNYVSWYQQHPGKAPKLMIYEVSNRPSGVSNRFSGSKSGNTASLTISGLQAEDEADYYCSSYTSSSTLVFGTGTKVTVLG

SEQ ID NO: 5184 - protein, 109 aa, Artificial Sequence
  Description of Artificial Sequence: Synthetic polypeptide
SYVLTQPPSVSVAPGQTARITCGGNNIGSKGVHWYQQKPGQAPVLVVYDDSDRPSGIPERFSGSNSGNTATLTISRVEAGDEADYYCQVWDSSSDHVVFGGGTKLTVLG

SEQ ID NO: 5185 - protein, 108 aa, Artificial Sequence
  Description of Artificial Sequence: Synthetic polypeptide
EIVMTQSPGTLSLSPGERATLSCRASQSVSSSYLAWYQQKPGQAPRLLIFGASSRATGIPDRFSGSGSGTDFTLTISRLEPEDFAVYYCQQYGSSLTFGGGTKLEIKR

SEQ ID NO: 5186 - protein, 109 aa, Artificial Sequence
  Description of Artificial Sequence: Synthetic polypeptide
EIVLTQSPGTLSLSPGERATLSCRASQSVSSNYLGWTQQKPGQAPRLLIYGASSRASGIPDRFSGGGSGTDFTLTISRLEPEDFAVYYCQQYGSSPLTFGGGTKVEIKR

SEQ ID NO: 5187 - protein, 109 aa, Artificial Sequence
  Description of Artificial Sequence: Synthetic polypeptide
QSVVTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLG

SEQ ID NO: 5188 - protein, 107 aa, Artificial Sequence
  Description of Artificial Sequence: Synthetic polypeptide
DIQLTQSPSSLSASVGDRVTITCRASQGISTYLAWYQQKPGKVPKLLIYAASTLQSGVPSRFSGSGSGTDFTLTISSLQPEDVATYYCQKYNSAPSFGPGTKVDIKR

SEQ ID NO: 5189 - protein, 109 aa, Artificial Sequence
  Description of Artificial Sequence: Synthetic polypeptide
SYVLTQPPSESVAPGQTARITCGGNNIGRNSVHWYQQKPGQAPVLVVYDDSDRPSGIPERFSGSKSGNTATLIISRVEVGDEADYYCQVWHSSSDHYVFGTGTKVTVLG

SEQ ID NO: 5190 - protein, 109 aa, Artificial Sequence
  Description of Artificial Sequence: Synthetic polypeptide
EIVMTQSPGTLSLSPGQRATLSCRASQSVSSSYLAWYQQKPGQAPRLLMYGASSRATGIPDRFSGSGSGTDFTLTISRLEPEDFAVYYCQQYGSSSLTFGGGTKLEIKR

SEQ ID NO: 5191 - protein, 109 aa, Artificial Sequence
  Description of Artificial Sequence: Synthetic polypeptide
QAGLTQPPSVSVAPGQTARITCGGNNIGSKSVHWYQQKPGQAPVLVVYDDSDRPSGIPERFSGSNSGNTATLTISRVEAGDEADYYCQVWDSSSDHVVFGGGTKLTVLG

SEQ ID NO: 5192 - protein, 114 aa, Artificial Sequence
  Description of Artificial Sequence: Synthetic polypeptide
DIQMTQSPDSLAVSLGEKATINCKSSQSILNSSNNKNYLAWYQQKPGQPPKLLIYWASTRESGVPDRFSGSGSGTDFTLTISSLQAEDVAVYYCQQYYSSPPTFGQGTKVEIKR

SEQ ID NO: 5193 - protein, 109 aa, Artificial Sequence
  Description of Artificial Sequence: Synthetic polypeptide
QSVVTQPPSESVAPGQTARITCGGHNIGSNSVHWYQQKPGQAPVLVVYDNSDRPSGIPERFSGSNSGNTATLTISRVEAGDEADYYCQVWGSSSDHYVFGTGTKVTVLG

SEQ ID NO: 5194 - protein, 111 aa, Artificial Sequence
  Description of Artificial Sequence: Synthetic polypeptide
TVLTQPPSVSGAPGQRVTISCTGSSSNIGAGYDVHWYQQLPGTAPKLLIYGNSNRPSGVPDRFSGSKSGTSATLGITGLQTGDEADYYCGTWDSSLSAYVFGTGTKVTVLG

SEQ ID NO: 5195 - protein, 114 aa, Artificial Sequence; identical to SEQ ID NO: 5169
  Description of Artificial Sequence: Synthetic polypeptide

SEQ ID NO: 5196 - protein, 111 aa, Artificial Sequence; identical to SEQ ID NO: 5170
  Description of Artificial Sequence: Synthetic polypeptide

SEQ ID NO: 5197 - protein, 111 aa, Artificial Sequence; identical to SEQ ID NO: 5171
  Description of Artificial Sequence: Synthetic polypeptide

SEQ ID NO: 5198 - protein, 111 aa, Artificial Sequence; identical to SEQ ID NO: 5172
  Description of Artificial Sequence: Synthetic polypeptide

SEQ ID NO: 5199 - protein, 112 aa, Artificial Sequence
  Description of Artificial Sequence: Synthetic polypeptide
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLG

SEQ ID NO: 5200 - protein, 109 aa, Artificial Sequence; identical to SEQ ID NO: 5174
  Description of Artificial Sequence: Synthetic polypeptide

SEQ ID NO: 5201 - protein, 107 aa, Artificial Sequence; identical to SEQ ID NO: 5175
  Description of Artificial Sequence: Synthetic polypeptide

SEQ ID NO: 5202 - protein, 111 aa, Artificial Sequence
  Description of Artificial Sequence: Synthetic polypeptide
GSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSSTHVFGTGTKVTVLG

SEQ ID NO: 5203 - protein, 109 aa, Artificial Sequence; identical to SEQ ID NO: 5177
  Description of Artificial Sequence: Synthetic polypeptide

SEQ ID NO: 5204 - protein, 113 aa, Artificial Sequence; identical to SEQ ID NO: 5178
  Description of Artificial Sequence: Synthetic polypeptide

SEQ ID NO: 5205 - protein, 108 aa, Artificial Sequence
  Description of Artificial Sequence: Synthetic polypeptide
EIVLYQSPGTLSLSPGERATLSCRASQRVSSYLAWYQQKPGQAPRLLIYGASTRAAGIPDRFSGSGSGTDFTLTISRLEPEDSAVYYCQQYGRTPLTFGGGTKVEIKR

SEQ ID NO: 5206 - protein, 109 aa, Artificial Sequence; identical to SEQ ID NO: 5180
  Description of Artificial Sequence: Synthetic polypeptide

SEQ ID NO: 5207 - protein, 111 aa, Artificial Sequence; identical to SEQ ID NO: 5181
  Description of Artificial Sequence: Synthetic polypeptide

SEQ ID NO: 5208 - protein, 109 aa, Artificial Sequence; identical to SEQ ID NO: 5182
  Description of Artificial Sequence: Synthetic polypeptide

SEQ ID NO: 5209 - protein, 111 aa, Artificial Sequence; identical to SEQ ID NO: 5183
  Description of Artificial Sequence: Synthetic polypeptide

SEQ ID NO: 5210 - protein, 109 aa, Artificial Sequence; identical to SEQ ID NO: 5184
  Description of Artificial Sequence: Synthetic polypeptide

SEQ ID NO: 5211 - protein, 108 aa, Artificial Sequence; identical to SEQ ID NO: 5185
  Description of Artificial Sequence: Synthetic polypeptide

SEQ ID NO: 5212 - protein, 109 aa, Artificial Sequence
  Description of Artificial Sequence: Synthetic polypeptide
EIVLTQSPGTLSLSPGERATLSCRASQSVSSNYLGWYQQKPGQAPRLLIYGASSRASGIPDRFSGGGSGTDFTLTISRLEPEDFAVYYCQQYGSSPLTFGGGTKVEIKR

SEQ ID NO: 5213 - protein, 109 aa, Artificial Sequence; identical to SEQ ID NO: 5187
  Description of Artificial Sequence: Synthetic polypeptide

SEQ ID NO: 5214 - protein, 107 aa, Artificial Sequence; identical to SEQ ID NO: 5188
  Description of Artificial Sequence: Synthetic polypeptide

SEQ ID NO: 5215 - protein, 109 aa, Artificial Sequence; identical to SEQ ID NO: 5189
  Description of Artificial Sequence: Synthetic polypeptide

SEQ ID NO: 5216 - protein, 109 aa, Artificial Sequence; identical to SEQ ID NO: 5190
  Description of Artificial Sequence: Synthetic polypeptide

SEQ ID NO: 5217 - protein, 109 aa, Artificial Sequence; identical to SEQ ID NO: 5191
  Description of Artificial Sequence: Synthetic polypeptide

SEQ ID NO: 5218 - protein, 114 aa, Artificial Sequence; identical to SEQ ID NO: 5192
  Description of Artificial Sequence: Synthetic polypeptide

SEQ ID NO: 5219 - protein, 109 aa, Artificial Sequence; identical to SEQ ID NO: 5193
  Description of Artificial Sequence: Synthetic polypeptide

SEQ ID NO: 5220 - protein, 111 aa, Artificial Sequence; identical to SEQ ID NO: 5194
  Description of Artificial Sequence: Synthetic polypeptide

SEQ ID NO: 5221 - protein, 236 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTDYNPSLKSRVTISVDTSKNQFSLKLSSVTAADTAVYYCARRRSDFETVDFIYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKHHHHHH

SEQ ID NO: 5222 - protein, 214 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQSYSIPLTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5223 - protein, 130 aa, Artificial Sequence
  Description of Artificial Sequence: Synthetic polypeptide
QLQLQESGPGLVKPSETLSLTCTASGGSINSSNFYWGWIRQPPGKGLEWIGSIFYSGTTYYNPSLKSRVTISVDTSKNQFSLKLSPVTAADTAVYHCARHGFRYCNNGVCSINLDAFDIWGQGTMVTVSS

SEQ ID NO: 5224 - protein, 331 aa, Artificial Sequence
  Description of Artificial Sequence: Synthetic polypeptide
SASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5225 - protein, 122 aa, Artificial Sequence
  Description of Artificial Sequence: Synthetic polypeptide
QVQLQESGPGLVKPSETLSLTCTVSNGAIGDYDWSWIRQSPGKGLEWIGNINYRGNTNYNPSLKSRVTMSLRTSTMQFSLKLSSATAADTAVYYCARDVGYGGGQYFAMDVWSPGTTVTVSS

SEQ ID NO: 5226 - protein, 129 aa, Artificial Sequence
  Description of Artificial Sequence: Synthetic polypeptide
QVQLVESGGGVVQPGGSLRLSCTASGFTFSTYGMHWVRQAPGKGLEWVAFIRYDGSTQDYVDSVKGRFTISRDNSKNMVYVQMNSLRVEDTAVYYCAKDMDYYGSRSYSVTYYYGMDVWGQGTTVTVSS

SEQ ID NO: 5227 - protein, 125 aa, Artificial Sequence
  Description of Artificial Sequence: Synthetic polypeptide
QVQLVQSGAEVKKPGASVKVSCKASGYTFSGYYMHWVRQAPGQGLEWMGWINTSSGGTNYAQKFQGRVTMTRDTSISTAHMELRRLRSDDTAVYYCAREDGTMGTNSWYGWFDPWGQGTLVTVSS

SEQ ID NO: 5228 - protein, 127 aa, Artificial Sequence
  Description of Artificial Sequence: Synthetic polypeptide
QVQLVESGGGLVKPGGSLRLSCAASGFPFGDYYMSWIRQAPGKGLEWVAYINRGGTTIYYADSVKGRFTISRDNAKNSLFLQMNSLRAGDTALYYCARGLILALPTATVELGAFDIWGQGTMVTVSS

SEQ ID NO: 5229 - protein, 126 aa, Artificial Sequence
  Description of Artificial Sequence: Synthetic polypeptide
QVQLQESGPGLVKPSQTLSLTCTVSGASISSGDYYWSWIRQSPRKGLEWIGYIFHSGTTYYNPSLKSRAVISLDTSKNQFSLRLTSVTAADTAVYYCARDVDDFPVWGMNRYLALWGRGTLVTVSS

SEQ ID NO: 5230 - protein, 124 aa, Artificial Sequence
  Description of Artificial Sequence: Synthetic polypeptide
QVQLVESGGGVVQPGRSLRLSCAASGFSFSHFGMHWVRQVPGKGLEWVAIISYDGNNVHYADSVKGRFTISRDNSKNTLFLQMNSLRDDDTGVYYCAKDDVATDLAAYYYFDVWGRGTLVTVSS

SEQ ID NO: 5231 - protein, 123 aa, Artificial Sequence
  Description of Artificial Sequence: Synthetic polypeptide
QVQLVESGGGVVQPGRSLKLSCEASGFNFNNYGMHWVRQAPGKGLEWVAVISYDGRNKYFADSVKGRFIISRDDSRNTVFLQMNSLRVEDTAVYYCARGSVQVWLHLGLFDNWGQGTLVTVSS

SEQ ID NO: 5232 - protein, 122 aa, Artificial Sequence
  Description of Artificial Sequence: Synthetic polypeptide
QVQLVESGGAVVQPGRSLRLSCEVSGFSFSDYGMNWVRQGPGKGLEWVAVIWHDGSNKNYLDSVKGRFTVSRDNSKNTLFLQMNSLRAEDTAVYYCARTPYEFWSGYYFDFWGQGTLVTVSS

SEQ ID NO: 5233 - protein, 116 aa, Artificial Sequence
  Description of Artificial Sequence: Synthetic polypeptide
QVQLVESGGGVVQPGRSLRLSCAASGFPFNSYAMHWVRQAPGKGLEWVAVIYYEGSNEYYADSVKGRFTISRDNSKNTLYLQMDSLRAEDTAVYYCARKWLGMDFWGQGTLVTVSS

SEQ ID NO: 5234 - protein, 120 aa, Artificial Sequence
  Description of Artificial Sequence: Synthetic polypeptide
EVQLVESGGGLVRPGGSLRLSCSASGFTFSNYAMHWVRQAPGKRLEYVSATSTDGGSTYYADSLKGTFTISRDNSKNTLYLQMSSLSTEDTAIYYCARRFWGFGNFFDYWGRGTLVTVSS

SEQ ID NO: 5235 - protein, 122 aa, Artificial Sequence
  Description of Artificial Sequence: Synthetic polypeptide
QVQLVQSGAEVKKSGSSVKVSCRASGGTFGNYAINWVRQAPGQGLEWVGRIIPVFDTTNYAQKFQGRVTITADRSTNTAIMQLSSLRPQDTAMYYCLRGSTRGWDTDGFDIWGQGTMVTVSS

SEQ ID NO: 5236 - protein, 129 aa, Artificial Sequence
  Description of Artificial Sequence: Synthetic polypeptide
QVQLVQSGAVVETPGASVKVSCKASGYIFGNYYIHWVRQAPGQGLEWMAVINPNGGSTTSAQKFQDRITVTRDTSTTTVYLEVDNLRSEDTATYYCARQRSVTGGFDAWLLIPDASNTWGQGTMVTVSS

SEQ ID NO: 5237 - protein, 126 aa, Artificial Sequence
  Description of Artificial Sequence: Synthetic polypeptide
QVQLVQSGAEMKKPGSSVKVSCKASGGSFSSYSISWVRQAPGRGLEWVGMILPISGTTNYAQTFQGRVIISADTSTSTAYMELTSLTSEDTAVYFCARVFREFSTSTLDPYYFDYWGQGTLVTVSS

SEQ ID NO: 5238 - protein, 125 aa, Artificial Sequence
  Description of Artificial Sequence: Synthetic polypeptide
QVQLVESGGGVVQPGKSVRLSCVGSGFRLMDYAMHWVRQAPGKGLDWVAVISYDGANEYYAESVKGRFTVSRDNSDNTLYLQMKSLRAEDTAVYFCARAGRSSMNEEVIMYFDNWGLGTLVTVSS

SEQ ID NO: 5239 - protein, 127 aa, Artificial Sequence
  Description of Artificial Sequence: Synthetic polypeptide
EVQLLESGGGLVQPGGSLRLSCVASGFTFSTYAMTWVRQAPGKGLEWVSVIRASGDSEIYADSVRGRFTISRDNSKNTVFLQMDSLRVEDTAVYFCANIGQRRYCSGDHCYGHFDYWGQGTLVTVSS

SEQ ID NO: 5240 - protein, 127 aa, Artificial Sequence
  Description of Artificial Sequence: Synthetic polypeptide
QVQLVESGGGVVQPGRSLRLSCAASGFGFNTHGMHWVRQAPGKGLEWLSIISLDGIKTHYADSVKGRFTISRDNSKNTVFLQLSGLRPEDTAVYYCAKDHIGGTNAYFEWTVPFDGWGQGTLVTVSS

SEQ ID NO: 5241 - protein, 126 aa, Artificial Sequence
  Description of Artificial Sequence: Synthetic polypeptide
QVTLRESGPAVVKPTETLTLTCAFSGFSLNAGRVGVSWIRQPPGQAPEWLARIDWDDDKAFRTSLKTRLSISKDSSKNQVVLTLSNMDPADTATYYCARTQVFASGGYYLYYLDHWGQGTLVTVSS

SEQ ID NO: 5242 - protein, 129 aa, Artificial Sequence
  Description of Artificial Sequence: Synthetic polypeptide
QVQLQESGPGLVKPSQTLSLTCTVSSGAISGADYYWSWIRQPPGKGLEWVGFIYDSGSTYYNPSLRSRVTISIDTSKKQFSLKLTSVTAADTAVYYCARDLGYGGNSYSHSYYYGLDVWGRGTTVTVSS

SEQ ID NO: 5243 - protein, 119 aa, Artificial Sequence
  Description of Artificial Sequence: Synthetic polypeptide
QVQLQESGPGLVKPSETLSLTCTVSGGSIGNYYWGWIRQPPGKGLEWIGHIYFGGNTNYNPSLQSRVTISVDTSRNQFSLKLNSVTAADTAVYYCARDSSNWPAGYEDWGQGTLVTVSS

SEQ ID NO: 5244 - protein, 123 aa, Artificial Sequence
  Description of Artificial Sequence: Synthetic polypeptide
QVQLVQSGAEVKKPGASVKVSCKVSGYTFTSNGLSWVRQAPGQGFEWLGWISASSGNKKYAPKFQGRVTLTTDISTSTAYMELRSLRSDDTAVYYCAKDGGTYVPYSDAFDFWGQGTMVTVSS

SEQ ID NO: 5245 - protein, 118 aa, Artificial Sequence
  Description of Artificial Sequence: Synthetic polypeptide
QVQLVQSGAEVKKPGASVKVSCRVSGHTFTALSKHWMRQGPGGGLEWMGFFDPEDGDTGYAQKFQGRVTMTEDTATGTAYMELSSLTSDDTAVYYCATVAAAGNFDNWGQGTLVTVSS

SEQ ID NO: 5246 - protein, 126 aa, Artificial Sequence
  Description of Artificial Sequence: Synthetic polypeptide
QVTLKESGPALVKATQTLTLTCTFSGFSLSRNRMSVSWIRQPPGKALEWLARIDWDDDKFYNTSLQTRLTISKDTSKNQVVLTMTNMDPVDTATYYCARTGIYDSSGYYLYYFDYWGQGTLVTVSS

SEQ ID NO: 5247 - protein, 130 aa, Artificial Sequence
  Description of Artificial Sequence: Synthetic polypeptide
QVQLVQSGAEVKVPGASVKVSCKASGYTFTTYGVSWVRQAPGQGLEWMGWISAYNGNTYYLQKLQGRVTMTTDTSTSTAYMELRGLRSDDTAMYYCARDRVGGSSSEVLSRAKNYGLDVWGQGTTVTVSS

SEQ ID NO: 5248 - protein, 123 aa, Artificial Sequence
  Description of Artificial Sequence: Synthetic polypeptide
QVQLVQSGAEVKKPGASVKVSCKASANIFTYAMHWVRQAPGQRLEWMGWINVGNGQTKYSQRFQGRVTITRDTSATTAYMELSTLRSEDTAVYYCARRASQYGEVYGNYFDYWGQGTLVTVSS

SEQ ID NO: 5249 - protein, 126 aa, Artificial Sequence
  Description of Artificial Sequence: Synthetic polypeptide
QVQLVQSGAEVKRPGASVKVSCKASGYTFISYGFSWVRQAPGQGLEWMGWSSVYNGDTNYAQKFHGRVNMTTDTSTNTAYMELRGLRSDDTAVYFCARDRNVVLLPAAPFGGMDVWGQGTMVTVSS

SEQ ID NO: 5250 - protein, 123 aa, Artificial Sequence
  Description of Artificial Sequence: Synthetic polypeptide
QVQLVESGGGVVQPGTSLRLSCAASGFTFSTFGMHWVRQAPGKGLEWVAVISYDGNKKYYADSVKGRFTISRDNSKNTLYLQVNSLRVEDTAVYYCAAQTPYFNESSGLVPDWGQGTLVTVSS

SEQ ID NO: 5251 - protein, 126 aa, Artificial Sequence
  Description of Artificial Sequence: Synthetic polypeptide
QVQLVQSGAEVKKPGASVKVSCKASGYTFISFGISWVRQAPGQGLEWMGWISAYNGNTDYAQRLQDRVTMTRDTATSTAYLELRSLKSDDTAVYYCTRDESMLRGVTEGFGPIDYWGQGTLVTVSS

SEQ ID NO: 5252 - protein, 128 aa, Artificial Sequence
  Description of Artificial Sequence: Synthetic polypeptide
EVQLVQSGAEVKKPGQSLKISCKTSGYIFTNYWIGWVRQRPGKGLEWMGVIFPADSDARYSPSFQGQVTISADKSIGTAYLQWSSLKASDTAIYYCARPKYYFDSSGQFSEMYYFDFWGQGTLVTVSS

SEQ ID NO: 5253 - protein, 119 aa, Artificial Sequence
  Description of Artificial Sequence: Synthetic polypeptide
QVQLVQSGPEVKKPGASVKVSCKASGYVLTNYAFSWVRQAPGQGLEWLGWISGSNGNTYYAEKFQGRVTMTTDTSTSTAYMELRSLRSDDTAVYFCARDLLRSTYFDYWGQGTLVTVSS

SEQ ID NO: 5254 - protein, 126 aa, Artificial Sequence
  Description of Artificial Sequence: Synthetic polypeptide
QVQLVQSGAEVKKPGASVKVSCKASGYTFSNYGFSWVRQAPGRGLEWMGWISAYNGNTYYAQNLQGRVTMTTDTSTTTAYMVLRSLRSDDTAMYYCARDGNTAGVDMWSRDGFDIWGQGTMVTVSS

SEQ ID NO: 5255 - protein, 131 aa, Artificial Sequence
  Description of Artificial Sequence: Synthetic polypeptide
EVQLLESGGGLVQPGGPLRLSCVASGFSFSSYAMNWIRLAPGKGLEWVSGISGSGGSTYYGDSVKGRFTISRDNSKNTLYLQMNSLRAEDTAVYYCAKEPWIDIVVASVISPYYYDGMDVWGQGTTVTVSS

SEQ ID NO: 5256 - protein, 123 aa, Artificial Sequence
  Description of Artificial Sequence: Synthetic polypeptide
QVQLVQSGAEVKKPGSSVKVSCKASGGSFDGYTISWLRQAPGQGLEWMGRVVPTLGFPNYAQKFQGRVTVTADRSTNTAYLELSRLTSEDTAVYYCARMNLGSHSGRPGFDMWGQGTLVTVSS

SEQ ID NO: 5257 - protein, 129 aa, Artificial Sequence
  Description of Artificial Sequence: Synthetic polypeptide
QVQLVESGGGVVQPGRSLRLSCAVSGSSFSKYGIHWVRQAPGKGLEWVAVISYDGSKKYFTDSVKGRFTIARDNSQNTVFLQMNSLRAEDTAVYYCATGGGVNVTSWSDVEHSSSLGYWGLGTLVTVSS

SEQ ID NO: 5258 - protein, 125 aa, Artificial Sequence
  Description of Artificial Sequence: Synthetic polypeptide
QVQLVESGGGVVQPGGSLRLSCAASGFTFSSYGMHWVRQAPGKGLEWVAFIWNDGSNKYYADSVKGRFTISRDNSKNTLYLQMNSLRAEDTAVYYCVKDEVYDSSGYYLYYFDSWGQGTLVTVSS

SEQ ID NO: 5259 - protein, 127 aa, Artificial Sequence
  Description of Artificial Sequence: Synthetic polypeptide
EVQLLESGGGLVQPGGSLRLSCAASGFTFSSYTMSWVRQAPGKGLEWVSSISASTVLTYYADSVKGRFTISRDNSKNTLYLQMSSLRAEDTAVYYCAKDYDFWSGYPGGQYWFFDLWGRGTLVTVSS

SEQ ID NO: 5260 - protein, 123 aa, Artificial Sequence
  Description of Artificial Sequence: Synthetic polypeptide
QVQLQESGPGLVTPSETLSVTCTVSNYSIDNAYYWGWIRQPPGKGLEWIGSIHHSGSAYYNSSLKSRATISIDTSKNQFSLNLRSVTAADTAVYYCARDTILTFGEPHWFDPWGQGTLVTVSS

SEQ ID NO: 5261 - protein, 124 aa, Artificial Sequence
  Description of Artificial Sequence: Synthetic polypeptide
QVQLQESGPGLVKPSETLSLTCTVSGDSISNYYWSWIRQPPGKGLEWIGEISNTWSTNYNPSLKSRVTISLDMPKNQLSLKLSSVTAADTAVYYCARGLFYDSGGYYLFYFQHWGQGTLVTVSS

SEQ ID NO: 5262 - protein, 125 aa, Artificial Sequence
  Description of Artificial Sequence: Synthetic polypeptide
QVQLVESGGGVVQPGRSLRVSCAASGFTFSNYGMHWVRQAPGKGLEWVAVIWYDDSNKQYGDSVKGRFTISRDNSKSTLYLQMDRLRVEDTAVYYCARASEYSISWRHRGVLDYWGQGTLVTVSS

SEQ ID NO: 5263 - protein, 126 aa, Artificial Sequence
  Description of Artificial Sequence: Synthetic polypeptide
QITLKESGPTLVRPTQTLTLTCTFSGFSLSTSKLGVGWIRQPPGKALEWLALVDWDDDRRYRPSLKSRLTVTKDTSKNQVVLTMTNMDPVDTATYYCAHSAYYTSSGYYLQYFHHWGPGTLVTVSS

SEQ ID NO: 5264 - protein, 125 aa, Artificial Sequence
  Description of Artificial Sequence: Synthetic polypeptide
EVQLVESGGGVVQPGGSLRLSCEVSGFTFNSYEMTWVRQAPGKGLEWVSHIGNSGSMIYYADSVKGRFTISRDNAKNSLYLQMNSLRVEDTAVYYCARSDYYDSSGYYLLYLDSWGHGTLVTVSS

SEQ ID NO: 5265 - protein, 120 aa, Artificial Sequence
  Description of Artificial Sequence: Synthetic polypeptide
QVQLVQSGAEVRKPGASVKVSCKASGHTFINFAMHWVRQAPGQGLEWMGYINAVNGNTQYSQKFQGRVTFTRDTSANTAYMELSSLRSEDTAVYYCARNNGGSAIIFYYWGQGTLVTVSS

SEQ ID NO: 5266 - protein, 122 aa, Artificial Sequence
  Description of Artificial Sequence: Synthetic polypeptide
QVQLVESGGGVVQPGRSLRLSCAASGFSFSSYGMHWVRQAPGKGLEWVAVISNDGSNKYYADSVKGRFTISRDNSKKTMYLQMNSLRAEDTAVYFCAKTTDQRLLVDWFDPWGQGTLVTVSS

SEQ ID NO: 5267 - protein, 122 aa, Artificial Sequence
  Description of Artificial Sequence: Synthetic polypeptide
QVQLVESGGGVVQPGKSLRLSCAASGFRFSDYGMHWVRQAPSKGLEWVAVIWHDGSNIRYADSVRGRFSISRDNSKNTLYLQMNSMRADDTAFYYCARVPFQIWSGLYFDHWGQGTLVTVSS

SEQ ID NO: 5268 - protein, 124 aa, Artificial Sequence
  Description of Artificial Sequence: Synthetic polypeptide
EEQLLESGGGLVKPGGSLRLSCAASGFTFSSYSMNWVRQAPGKGLEWVSSISASSSYSDYADSAKGRFTISRDNAKTSLFLQMNSLRAEDTAIYFCARARATGYSSITPYFDIWGQGTLVTVSS

SEQ ID NO: 5269 - protein, 124 aa, Artificial Sequence
  Description of Artificial Sequence: Synthetic polypeptide
EVQLVESGGGLVKPGGSLRLSCAASGFTFSSYSMNWVRQAPGKGLEWVSSISASSSYSDYADSAKGRFTISRDNAKTSLFLQMNSLRAEDTAIYFCARARATGYSSITPYFDIWGQGTLVTVSS

SEQ ID NO: 5270 - protein, 122 aa, Artificial Sequence
  Description of Artificial Sequence: Synthetic polypeptide
EVHLVESGGGLVKPGGSLRLSCAASGFAFTGYGLNWVRQVPGKGLEWVSSITAGSSYIDYAESVKGRFTISRDNGKNTLFLQMSDLRADDTAVYYCARVASPLVRGLHLDYWGQGALVTVSS

SEQ ID NO: 5271 - protein, 122 aa, Artificial Sequence
  Description of Artificial Sequence: Synthetic polypeptide
EVQLVESGGGLVKPGGSLRLSCAASGFAFTGYGLNWVRQVPGKGLEWVSSITAGSSYIDYAESVKGRFTISRDNGKNTLFLQMSDLRADDTAVYYCARVASPLVRGLHLDYWGQGALVTVSS

SEQ ID NO: 5272 - protein, 124 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARARATGYNSITPYFDIWGQGTLVTVSS

SEQ ID NO: 5273 - protein, 122 aa, Artificial Sequence
  Description of Artificial Sequence: Synthetic polypeptide
EVQLVESGGGLVKPGGSLRLSCAASGFTFSSYSMNWVRQAPGKGLEWVSSISSSSSYIYYADSVKGRFTISRDNAKNSLYLQMNSLRAEDTAVYYCARVASPMVRGLHFDYWGQGTLVTVSS

SEQ ID NO: 5274 - protein, 120 aa, Artificial Sequence
  Description of Artificial Sequence: Synthetic polypeptide
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSS

SEQ ID NO: 5275 - protein, 124 aa, Artificial Sequence
  Description of Artificial Sequence: Synthetic polypeptide
QVQLVQSGAEVKKPGATVKVSCKISGHTLIKLSIHWVRQAPGKGLEWMGGYEGEVDEIFYAQKFQHRLTVIADTATDTVYMELGRLTSDDTAVYFCGTLGVTVTEAGLGIDDYWGQGTLVTVSS

SEQ ID NO: 5276 - protein, 123 aa, Artificial Sequence
  Description of Artificial Sequence: Synthetic polypeptide
LEESGGDLVQPGRSLRLSCSTSGFSFGDYPVNWFRQAPGKGLEWLGIVRSRLYGGTLQYAASVEGRFTISRDDSKSIAYLHMNSLKSEDTAVYYCGVPVANIDYWGQGTLVTVSSASTKGPSS

SEQ ID NO: 5277 - protein, 120 aa, Artificial Sequence
  Description of Artificial Sequence: Synthetic polypeptide
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGQGTTVTVSS

SEQ ID NO: 5278 - protein, 120 aa, Artificial Sequence; identical to SEQ ID NO: 5274
  Description of Artificial Sequence: Synthetic polypeptide

SEQ ID NO: 5279 - protein, 120 aa, Artificial Sequence
  Description of Artificial Sequence: Synthetic polypeptide
QVTLRESGPALVKPTQTLTLTCTFSGFSLSTAGMSVGWIRQPPGKALEWLADIWWDGKKSYNPSLKDRLTISKDTSKNQVVLKVTNMDPADTATYYCARDMIFNFYFDVWGQGTTVTVSS

SEQ ID NO: 5280 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDGKKDYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5281 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDGKKSYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5282 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKSYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5283 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDGKKHYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5284 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5285 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKSYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5286 - protein, 450 aa, Artificial Sequence
  Description of Artificial Sequence: Synthetic polypeptide
QVTLRESGPALVKPTQTLTLTCTFSGFSLSTPGMSVGWIRQPPGKALEWLADIWWDGKKHYNPSLKDRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5287 - protein, 450 aa, Artificial Sequence
  Description of Artificial Sequence: Synthetic polypeptide
QVTLRESGPALVKPTQTLTLTCTFSGFSLSTPGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5288 - protein, 450 aa, Artificial Sequence
  Description of Artificial Sequence: Synthetic polypeptide
QVTLRESGPALVKPTQTLTLTCTFSGFSLSTPGMSVGWIRQPPGKALEWLADIWWDGKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5289 - protein, 117 aa, Artificial Sequence
  Description of Artificial Sequence: Synthetic polypeptide
QVQLVQSGAEVKKPGASVKVSCKASGFNIKDYYIYWVRQAPGQGLEWIGWIDPENGNTVFDPKFNGRVTMTRDTSTSTVYMELSSLRSEDTAVYYCAYYGTSSFDFWGQGTTLTVSS

SEQ ID NO: 5290 - protein, 117 aa, Artificial Sequence
  Description of Artificial Sequence: Synthetic polypeptide
EVQKQQSGAELVRPGALVKLSCKASGFNIKDYYIYWVKQRPEQGLEWIGWIDPENGNTVFDPLFQGKASITSDTSSNTAYLQLSSLTSEDTAVYYCAYYGTSSFDFWGQGTTLTVSS

SEQ ID NO: 5291 - protein, 123 aa, Artificial Sequence
  Description of Artificial Sequence: Synthetic polypeptide
QVTLRESGPALVKPTQTLTLTCTFSGFSLSSSGMCVGWIRQPPGKALEWLADIEWDDDKDYNTSLDTRLTISKDTSKNQVVLTVTNMDPADTATYYCARKTVIPAPAGYMDVWGRGRPVTVSS

SEQ ID NO: 5292 - protein, 120 aa, Artificial Sequence
  Description of Artificial Sequence: Synthetic polypeptide
QVELQESGPGILQPSQTLSLTCSFSGFSLSTSGMSVGWIRQPSGEGLEWLADIWWDDKKDYNPSLKSRKTISKDTSSNQVFLKITGVDTADTATYYCARSMITNWYFDVWGAGTTVTVSS

SEQ ID NO: 5293 - protein, 126 aa, Artificial Sequence
  Description of Artificial Sequence: Synthetic polypeptide
EVQLVESGGGLAQPGGSLTLACAASGFTFTSYNMHWVRQAPGKGLEWVSYITSNSLNIYYADSVKGRFTISRDNAKNSLYLRMHSLSDEDTSVYYCARDSSGSIGWSDPLDYWGQGTLVTVSSAGT

SEQ ID NO: 5294 - protein, 120 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARSMITNFYFDVWGQGTTVTVSS

SEQ ID NO: 5295 - protein, 120 aa, Artificial Sequence; identical to SEQ ID NO: 5294
  Description of Artificial Sequence: Synthetic polypeptide

SEQ ID NO: 5296 - protein, 120 aa, Artificial Sequence
  Description of Artificial Sequence: Synthetic polypeptide
QVTLRESGPALVKPTQTLTLTCTFSGFSLSTPGMSVGWIRQPPGKALEWLADIWWDDKKDYNPSLKSRLTISKDTSKNQVVLKVTNMDPADTATYYCARSMITNFYFDVWGQGTTVTVSS

SEQ ID NO: 5297 - protein, 120 aa, Artificial Sequence; identical to SEQ ID NO: 5294
  Description of Artificial Sequence: Synthetic polypeptide

SEQ ID NO: 5298 - protein, 120 aa, Artificial Sequence; identical to SEQ ID NO: 5294
  Description of Artificial Sequence: Synthetic polypeptide

SEQ ID NO: 5299 - protein, 126 aa, Artificial Sequence
  Description of Artificial Sequence: Synthetic polypeptide
QVTLKESGPVLVKPTETLTLTCTVSGFSLSNARMGVSWIRQPPGKALEWLARIDWDDDKYYSTSLKTRLTISKDTPKNQVVLTMTNMDPVDTATYYCARNSYYDSSGYYLLYFDYWGQGTLVTVSS

SEQ ID NO: 5300 - protein, 97 aa, Artificial Sequence
  Description of Artificial Sequence: Synthetic polypeptide
QVQLVQSGAEVKKPGASVKVSCKASGYTFNSYYMHWVRQAPGQGLEWMGIINPSGGSTSYAQKFQGRVTMTRDTSTSTVYMELSSLRSEDTAVYYCA

SEQ ID NO: 5301 - protein, 109 aa, Artificial Sequence
  Description of Artificial Sequence: Synthetic polypeptide
DIQLTQSPSSLSASVGDRVTITCSGSSSNIGRWGVNWYQQKPGKAPKLLIYYESSRPSGVPSRFSGSGSGTDFTFTISSLQPEDIATYYCATGDYNIAVFGQGTKLEIK

SEQ ID NO: 5302 - protein, 111 aa, Artificial Sequence
  Description of Artificial Sequence: Synthetic polypeptide
DIQLTQSPSSLSASVGDRVTITCSGSSDNIGIFAVGWYQQKPGKAPKLLIYGNTKRPSGVPSRFSGSGSGTDFTFTISSLQPEDIATYYCVCGESKSATPVFGQGTKLEIK

SEQ ID NO: 5303 - protein, 228 aa, Artificial Sequence
  Description of Artificial Sequence: Synthetic polypeptide
QVQLVQSGPGLVKPSQTLALTCNVSGASINSDNYYWTWIRQRPGGGLEWIGHISYTGNTYYTPSLKSRLSMSLETSQSQFSLRLTSVTAADSAVYFCAACGAYVLISNCGWFDSWGQGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5304 - protein, 228 aa, Artificial Sequence
  Description of Artificial Sequence: Synthetic polypeptide
QVQLQESGPGLVKPSGTLSLTCTVSGDSISGSNWWNWVRQPPGKGLEWIGEIYYRGTTNYKSSLKGRVTMSVDTSKNQFSLKLTSVTAADTAVYYCARGGRSTFGPDYYYYMDVWGRGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 5305 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHLYWDDDKRYNPSLKSRLTITKDTSKNQVVLTMTNMDPVDTATYYCARLYGFTYGFAYWGQGTLVTVSS

SEQ ID NO: 5306 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLWGFRYGFAYWGQGTLVTVSS

SEQ ID NO: 5307 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLWGFKYGFAYWGQGTLVTVSS

SEQ ID NO: 5308 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLWGFAYGFAYWGQGTLVTVSS

SEQ ID NO: 5309 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFRYGFAYWGQGTLVTVSS

SEQ ID NO: 5310 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFKYGFAYWGQGTLVTVSS

SEQ ID NO: 5311 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFAYGFAYWGQGTLVTVSS

SEQ ID NO: 5312 - protein, 119 aa, Artificial Sequence
  Description of Artificial Sequence: Synthetic polypeptide
EVQLVESGGGLVQPGGSLRLSCAASGVSLSGYKMNWVRQAPGKGLEWVSSITGMSNYIHYSDSVKGRFTISRDNAMNSLYLQMNSLTAEDTGVYYCATQPGELAPFDHWGQGTLVTVSS

SEQ ID NO: 5313 - protein, 138 aa, Artificial Sequence
  Description of Artificial Sequence: Synthetic polypeptide
MGWSCIILFLVATATGVHSEVQLLESGGGLVQPGGSLRLSCAASGVSLSGYKMNWVRQAPGKGLEWVSSITGMSNYIHYSDSVKGRFTISRDNAMNSLYLQMNSLTAEDTGVYYCATQPGELAPFDHWGQGTLVTVSS

SEQ ID NO: 5314 - protein, 138 aa, Artificial Sequence
  Description of Artificial Sequence: Synthetic polypeptide
MGWSCIILFLVATATGVHSEVQLVESGGGLVQPGGSLRLSCAASGVSLSGYKMNWVRQAPGKGLEWVSSITGMSNYIHYSDSVKGRFTISRDNAMNSLYLQMNSLTAEDTGVYYCATQPGELAPFDHWGQGTLVTVSS

SEQ ID NO: 5315 - protein, 139 aa, Artificial Sequence
  Description of Artificial Sequence: Synthetic polypeptide
MGWSCIILFLVATATGVHSEVQLLEVESGGGLRPGGSLRLSCAASGTTLSGYTMHWVRQAPGKGLEWVSSITGGSNFINYSDSVKGRFTISRDNAKNSLYLQMNSLTAEDTAVYYCATAPIAPPYFDHWGQGTLVTVSS

SEQ ID NO: 5316 - protein, 138 aa, Artificial Sequence
  Description of Artificial Sequence: Synthetic polypeptide
MEFGLSWVFLVALLRGVQCQVQLVVESGGGLRPGGSLRLSCAASGTTLSGYTMHWVRQAPGKGLEWVSSITGGSNFINYSDSVKGRFTISRDNAKNSLYLQMNSLTAEDTAVYYCATAPIAPPYFDHWGQGTLVTVSS

SEQ ID NO: 5317 - protein, 138 aa, Artificial Sequence
  Description of Artificial Sequence: Synthetic polypeptide
MEFGLSWVFLVALLRGVQCQVQLVVESGGGLRPGGSLRLSCAASGTTLSGYTMHWVRQAPGKGLEWVSSITGGSNFINYADSVKGRFTISRDNAKNSLYLQMNSLTAEDTAVYYCATAPIAPPYFDHWGQGTLVTVSS

SEQ ID NO: 5318 - protein, 138 aa, Artificial Sequence
  Description of Artificial Sequence: Synthetic polypeptide
MEFGLSWVFLVALLRGVQCQVQLVVESGGGLRPGGSLRLSCAASGTTLSGYTMHWVRQAPGKGLEWVSSITGGSNFIQYSDSVKGRFTISRDNAKNSLYLQMNSLTAEDTAVYYCATAPIAPPYFDHWGQGTLVTVSS

SEQ ID NO: 5319 - protein, 129 aa, Artificial Sequence
  Description of Artificial Sequence: Synthetic polypeptide
QVQLQESGPGLVRPSQTLSLTCTVSGFSLSSYSVSWVRQPPGRGLEWLGDASNGGIIYYNPALKSRVTMLRDTSKNQFSLRLSSVTAADTAVYYCAKCSVGDSGSYACTGRKGEYVDAWGQGTTVTVSS

SEQ ID NO: 5320 - protein, 133 aa, Artificial Sequence
  Description of Artificial Sequence: Synthetic polypeptide
  MOD_RES (120)..(120): Any amino acid
QVQLQESGPGLVRPSQTLSLTCTVSGLSLSDHNVGWVRQPPGRGLEWLGVIYKEGDKDYNPALKSRVTMLKDTSKNQFSLRLSSVTAADTAVYYCATLGCYFVEGVGYDCTYGLQHTTFXDAWGQGTTVTVSS

SEQ ID NO: 5321 - protein, 116 aa, Artificial Sequence
  Description of Artificial Sequence: Synthetic polypeptide
  MOD_RES (6)..(6): Any amino acid
QVQLQXSGTELERSGASVKLSCTASGFNIKDYYMHWMKQRPDQGLEWIGWIDPENDDVQYAPKFQGKATMTADTSSNTAYLQLTSLTFEDTAVYFCNSWGSDFDHWGQGTTVTVSS

SEQ ID NO: 5322 - protein, 115 aa, Artificial Sequence
  Description of Artificial Sequence: Synthetic polypeptide
QVQLQESGPGLVRPSQTLSLTCTVSGFTESDYYMHWVRQPPGRGLEWIGWIDPENDDVQYAPKFQGRVTMLVDTSKNQFSLRLSSVTAADTAVYCARWGSDFDHWGQGTTVTVSS

SEQ ID NO: 5323 - protein, 116 aa, Artificial Sequence
  Description of Artificial Sequence: Synthetic polypeptide
QVQLQESGPGLVRPSQTLSLTCTVSGFTMEDYYMHWVRQPPGRGLEWIGWIDPENDDVQYAPKFQGRVTMLVDTSKNQFSLRLSSVTAADTAVYFCNSWGSDFDHWGQGTTVTVSS

SEQ ID NO: 5324 - protein, 450 aa, Artificial Sequence; identical to SEQ ID NO: 5287
  Description of Artificial Sequence: Synthetic polypeptide

SEQ ID NO: 5325 - protein, 450 aa, Artificial Sequence; identical to SEQ ID NO: 5287
  Description of Artificial Sequence: Synthetic polypeptide

SEQ ID NO: 5326 - protein, 450 aa, Artificial Sequence; identical to SEQ ID NO: 5286
  Description of Artificial Sequence: Synthetic polypeptide

SEQ ID NO: 5327 - protein, 450 aa, Artificial Sequence; identical to SEQ ID NO: 5283
  Description of Artificial Sequence: Synthetic polypeptide

SEQ ID NO: 5328 - protein, 450 aa, Artificial Sequence; identical to SEQ ID NO: 5280
  Description of Artificial Sequence: Synthetic polypeptide

SEQ ID NO: 5329 - protein, 450 aa, Artificial Sequence; identical to SEQ ID NO: 5281
  Description of Artificial Sequence: Synthetic polypeptide

SEQ ID NO: 5330 - protein, 450 aa, Artificial Sequence; identical to SEQ ID NO: 5281
  Description of Artificial Sequence: Synthetic polypeptide

SEQ ID NO: 5331 - protein, 450 aa, Artificial Sequence; identical to SEQ ID NO: 5284
  Description of Artificial Sequence: Synthetic polypeptide

SEQ ID NO: 5332 - protein, 450 aa, Artificial Sequence; identical to SEQ ID NO: 5285
  Description of Artificial Sequence: Synthetic polypeptide

SEQ ID NO: 5333 - protein, 451 aa, Artificial Sequence
  Description of Artificial Sequence: Synthetic polypeptide
QVTLRESGPALVKPTQTLTLTCTFSGFSLSTSGMSVGYWIRQPPGKALEWLADIWWDDKKDYNPSLKSRLTISKDTSKNQVVLKVTNMDPADTATYYCARSMITNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5334 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTYKQTSGVPSRFSGSGSGTEFTLTISSLQPDDFATYYCFQGSGYPFTFGGGTKLEIK

SEQ ID NO: 5335 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYNPSLKSRLTITKDTSKNQVVLTMTNMDPVDTATYYCARLYGFTYGFAYWGQGTLVTVSS

SEQ ID NO: 5336 - protein, 120 aa, Artificial Sequence
  Description of Artificial Sequence: Synthetic polypeptide
QVTLKESGPGILQPSQTLSLTCSFSGFSLSTSGMGVSWIRQPSGKGLEWLAHIYWDDDKRYNPSLKSRLTISKDTSRNQVFLKITSVDTADTATYYCARLYGFTYGFAYWGQGTLVTVSA

SEQ ID NO: 5337 - protein, 118 aa, Artificial Sequence
  Description of Artificial Sequence: Synthetic polypeptide
EVQLQQSGAELVRPGALVKLSCKASGFNIKDYYMYWVKQRPEQGLEWIGWIDPENGNTVYDPKFQGKASITADTSSNTAYLQLSSLASEDTAVYYCAYYGTSYWFPYWGQGTLVTVSA

SEQ ID NO: 5338 - protein, 120 aa, Artificial Sequence
  Description of Artificial Sequence: Synthetic polypeptide
QVTLRESGPALVKPTQTLTLTCTFSGFSLSTPGMSVGWIRQPPGKALEWLADIWWDDKKHYNPSLKDRLTISKDTSKNQVVLKVTNMDPADTATYYCARDMIFNFYFDVWGAGTTVTVSS

SEQ ID NO: 5339 - protein, 120 aa, Artificial Sequence
  Description of Artificial Sequence: Synthetic polypeptide
QVTLRESGPALVKPTQTLTLTCTFSGFSLSTPGMSVGWIRQPPGKALEWLADIWWDGKKHYNPSLKDRLTISKDTSKNQVVLKVTNMDPADTATYYCARDMIFNFYFDVWGQGTTVTVSS

SEQ ID NO: 5340 - protein, 120 aa, Artificial Sequence
  Description of Artificial Sequence: Synthetic polypeptide
QVTLRESGPALVKPTQTLTLTCTFSGFSLSTPGMSVGWIRQPPGKALEWLADIWWDGKKHYNPSLKDRLTISKDTSKNQVVLKVTNMDPADTATYYCARDMIFNWYFDVWGQGTTVTVSS

SEQ ID NO: 5341 - protein, 120 aa, Artificial Sequence; identical to SEQ ID NO: 5340
  Description of Artificial Sequence: Synthetic polypeptide

SEQ ID NO: 5342 - protein, 120 aa, Artificial Sequence
  Description of Artificial Sequence: Synthetic polypeptide
QVTLRESGPALVKPTQTLTLTCTFSGFSLSTAGMSVGWIRQPPGKALEWLADIWWDGKKDYNPSLKDRLTISKDTSKNQVVLKVTNMDPADTATYYCARDMIFNFYFDVWGQGTTVTVSS

SEQ ID NO: 5343 - protein, 120 aa, Artificial Sequence; identical to SEQ ID NO: 5279
  Description of Artificial Sequence: Synthetic polypeptide

SEQ ID NO: 5344 - protein, 120 aa, Artificial Sequence; identical to SEQ ID NO: 5279
  Description of Artificial Sequence: Synthetic polypeptide

SEQ ID NO: 5345 - protein, 120 aa, Artificial Sequence [sequence omitted]

SEQ ID NO: 5346 - protein, 120 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKSYNPSLKDRLTISKDTSKNQVVLKVTNMDPADTATYYCARDMIFNWYFDVWGQGTTVTVSS

SEQ ID NO: 5347 - protein, 213 aa, Artificial Sequence
  Description of Artificial Sequence: Synthetic polypeptide
DIQMTQSPSTLSASVGDRVTITCSASSSVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5348 - protein, 122 aa, Artificial Sequence
  Description of Artificial Sequence: Synthetic polypeptide
QVQLVQSGAEVKKPGSSVKVSCKASGGTLSNNAFSWVRQAPGQGLEWLGGFNPIFDTANYAQKFQGRITITLDASTGTVYMELSSLRSEDTGVYYCAGTGAHFEFWGQGTLVTVSSASTKGP

SEQ ID NO: 5349 - protein, 122 aa, Artificial Sequence
  Description of Artificial Sequence: Synthetic polypeptide
QVQLVESGGGVVQPGRSLRLSCAASGFTFNSYGMHWVRQAPGKGLEWVTFIWSDGSNKYYLDSVKGRFTISRDNSKNTLYLQMNSLRAEDTAVYYCARSGLASYYYYGMDVWGQGTTVTVSS

SEQ ID NO: 5350 - protein, 122 aa, Artificial Sequence
  Description of Artificial Sequence: Synthetic polypeptide
QVQLVESGGGVVQPGRSLRLSCAASGFTFSSYGMHWVRQAPGKGLEWVVFLWYDGSNKHYADSVKGRFTISRDNSKNTLYLQMNSLRAEDTAVYYCARSGLASYYYYSMDVWGQGTTVTVSS

SEQ ID NO: 5351 - protein, 118 aa, Artificial Sequence
  Description of Artificial Sequence: Synthetic polypeptide
QVQLVQSGAEVKKPGASVKVSCKASGYTLTGYYLHWVRQAPGQGLEWMGWINPTSGGTNYAQKFQGRVTMTRDTSISAAFMELSRLRSDDTAVYHCAREFWPHGMDVWGQGTTVTVSS

SEQ ID NO: 5352 - protein, 126 aa, Artificial Sequence
  Description of Artificial Sequence: Synthetic polypeptide
EVQLVESGGGLVHPGGSLRLSCEASGFTLSSHVMSWVRQVPGKGLEWVSRISGPGGSTKYADSVQGRFTTSRDNSKNTLYLQMNSLIAEDSAAYYCAKGGGYSGYDWDFYYGMDVWGQGTTVTVSS

SEQ ID NO: 5353 - protein, 122 aa, Artificial Sequence
  Description of Artificial Sequence: Synthetic polypeptide
QVQLVQSGAEVKKSGSSVKVSCKASGGTFSSYAISWVRQAPGQGLEWMGGIIPIFGTGNYAQKFQGRVTITTDESTSTAYMELSSLRSEDTAVYYCARDSSSSPRYYGMDVWGHGTTVTVSS

SEQ ID NO: 5354 - protein, 125 aa, Artificial Sequence
  Description of Artificial Sequence: Synthetic polypeptide
EVQLVESGGGLVQPGGSLRLSCEASGFTFSTYWMSWVRQAPGKGLEWVANIKQDGSVKYFVDSVKGRFTVSRDNAKNSLYLQMNSLRAEDTALYHCARERHRGSYYGYYDGMDVWGQGTTVTVSS

SEQ ID NO: 5355 - protein, 123 aa, Artificial Sequence
  Description of Artificial Sequence: Synthetic polypeptide
EVQLVESGGGLVQPGRSLRLSCAASGFTFDDYAMHWVRQTPGKGLEWISGISWSSGTIVYADSVKGRFTISRDNAKNSLYLQMNSLRGEDTALYHCAKDGYRWKSYSYGLDVWGQGTTVTVSS

SEQ ID NO: 5356 - protein, 123 aa, Artificial Sequence
  Description of Artificial Sequence: Synthetic polypeptide
EVQLVESGGDLVQPGRSLRLSCVASGFTFDDYAMHWVRQAPGKGLEWVSGVSWSGSTVGYADSVKGRFTVSRDNAQKSLYLQMNSLRAEDTALYYCVKDAYKWNYYYYGLDVWGQGTTVTVSS

SEQ ID NO: 5357 - protein, 123 aa, Artificial Sequence
  Description of Artificial Sequence: Synthetic polypeptide
EVQLVESGGGLVQPGGSLRLSCGASGFTFRDFDMNWVRQAPGRGLEWVSGIGGSGGNTYYADSVKGRFTISRDNSKNTLFLQMSSLRAEDTAVYYCVKDPYGDYRNYYGMDVWGQGTTVTVSS

SEQ ID NO: 5358 - protein, 123 aa, Artificial Sequence
  Description of Artificial Sequence: Synthetic polypeptide
EVQLVESGGGLGQPGGSLRLSCGASGFMFRNYAMSWVRQAPGKGLEWVSTILDSGDNTYYADSVKGRFTISRDNSKNTLYLQMNSLRAEDTAVYYCAKDPYGDYRDYYGMDVWGQGTTVTVSS

SEQ ID NO: 5359 - protein, 128 aa, Artificial Sequence
  Description of Artificial Sequence: Synthetic polypeptide
QVQLQESGPGLVKPSETLSLTCTVSGGSISGYYWTWIRQPPGKGLEWIGYIYYSGATNYNPSLKSRVTISLDTSKNQFSLKLSSVTAADTAVYYCARDGNYDILTGYYNYHYYGMDVWGQGTTVTVSS

SEQ ID NO: 5360 - protein, 122 aa, Artificial Sequence
  Description of Artificial Sequence: Synthetic polypeptide
QVQLVESGGGLVKPGGSLRLSCAASGFTFSDYYMTWIRQAPGRGLEWVSYISDTGSHLYYADSVRGRFTISRDNAKNSLYLQMNNLRAEDTAVYYCARDQDGEMELRFFDYWGQGTLVTVSS

SEQ ID NO: 5361 - protein, 127 aa, Artificial Sequence
  Description of Artificial Sequence: Synthetic polypeptide
QVQLQESGPGLVKPSETLSLTCTVSGGFISNYYWSWIRQPPGKGLEWIGYIYYSGSTKYNPSLKSRVTISVDTSKNQFSLKLSSVSAADTAVYYCARDGVVAAAGPPYHYHYGLDVWGQGTTVTVSS

SEQ ID NO: 5362 - protein, 124 aa, Artificial Sequence
  Description of Artificial Sequence: Synthetic polypeptide
QVQLVESGGGLVKPGGSLRLSCAASGFTFSDYYMTWIRQVPGKGLEWVSYISSTGNNRYYGDSVKGRFAISRDNAKNLLFLQMNSLKAEDTAVYYCARENNWNPYFFYYGMDVWGQGTTVTVSS

SEQ ID NO: 5363 - protein, 117 aa, Artificial Sequence
  Description of Artificial Sequence: Synthetic polypeptide
QVQLVESGGGVVQPGRSLRLSCAASGFTFSSYGMHWVRQAPGKGLEWVAVIYYEGSNDYYVDSVKGRFTISRDNSKNTLYLQMNSLRAEDTAVYYCARRDWNSFDYWGQGTLVTVSS

SEQ ID NO: 5364 - protein, 123 aa, Artificial Sequence
  Description of Artificial Sequence: Synthetic polypeptide
EVQLVESGGDLVQPGRSLRLSCVASGFTFDDYAMHWVRQAPGKGLEWVSGVSWSGSTVGYADSVKGRFTVSRDNAQKSLYLQMNSLRAEDTALYYCVKDAYKYNYYYYGLDVWGQGTTVTVSS

SEQ ID NO: 5365 - protein, 123 aa, Artificial Sequence
  Description of Artificial Sequence: Synthetic polypeptide
EVQLVESGGDLVQPGRSLRLSCVASGFTFDDYAMHWVRQAPGKGLEWVSGVSWSGSTVGYADSVKGRFTVSRDNAQKSLYLQMNSLRAEDTALYYCVKDAYKFNYYYYGLDVWGQGTTVTVSS

SEQ ID NO: 5366 - protein, 123 aa, Artificial Sequence
  Description of Artificial Sequence: Synthetic polypeptide
QVQLEQSGAEVKKPGASVRISCKASGDTFTGYYINWVRQAPGQGLEWMGWINTNSGGTYFSQKFQVRVILTRDTSINTAYMELSRLRSDDTAVYYCARMFYDILTNSDIFDIWGQGTMVTVSS

SEQ ID NO: 5367 - protein, 115 aa, Artificial Sequence
  Description of Artificial Sequence: Synthetic polypeptide
QVQLQQWGAGLLKPSETLSLTCAVYGGSLSDYYWSWIRQPPGKGLEWIGEINHSGDTNYDPSLKSRLTISVDTSKNQFSLKLNSVTAADTAVYYCASLYFNFWMWGRGALVTVSS

SEQ ID NO: 5368 - protein, 123 aa, Artificial Sequence
  Description of Artificial Sequence: Synthetic polypeptide
QVQLEQSGAEVKKPGTSVRISCKASGDIFTGYYMNWVRQAPGQGLEWMGWINTNSGGTYFSQRFQGRVTLTRDTSIRTAYMELSRLRSDDTAVYYCARMFYDILTGSDVFDIWGQGTMVTVSS

SEQ ID NO: 5369 - protein, 128 aa, Artificial Sequence
  Description of Artificial Sequence: Synthetic polypeptide
EVQLVESGGGLVQPGGSLRLSCAASGFTISNYEMNWVRQAPGKGLEWVSYISTSGITIYYADSVQGRFTISRDNAKNSLYLQLNSLRAEDTAVYYCARGYCTNGVCYPHYYYSDMDVWGQGTTVTVSS

SEQ ID NO: 5370 - protein, 122 aa, Artificial Sequence; identical to SEQ ID NO: 5225
  Description of Artificial Sequence: Synthetic polypeptide

SEQ ID NO: 5371 - protein, 129 aa, Artificial Sequence; identical to SEQ ID NO: 5226
  Description of Artificial Sequence: Synthetic polypeptide

SEQ ID NO: 5372 - protein, 125 aa, Artificial Sequence; identical to SEQ ID NO: 5227
  Description of Artificial Sequence: Synthetic polypeptide

SEQ ID NO: 5373 - protein, 127 aa, Artificial Sequence; identical to SEQ ID NO: 5228
  Description of Artificial Sequence: Synthetic polypeptide

SEQ ID NO: 5374 - protein, 126 aa, Artificial Sequence; identical to SEQ ID NO: 5229
  Description of Artificial Sequence: Synthetic polypeptide

SEQ ID NO: 5375 - protein, 124 aa, Artificial Sequence; identical to SEQ ID NO: 5230
  Description of Artificial Sequence: Synthetic polypeptide

SEQ ID NO: 5376 - protein, 123 aa, Artificial Sequence; identical to SEQ ID NO: 5231
  Description of Artificial Sequence: Synthetic polypeptide

SEQ ID NO: 5377 - protein, 122 aa, Artificial Sequence; identical to SEQ ID NO: 5232
  Description of Artificial Sequence: Synthetic polypeptide

SEQ ID NO: 5378 - protein, 116 aa, Artificial Sequence; identical to SEQ ID NO: 5233
  Description of Artificial Sequence: Synthetic polypeptide

SEQ ID NO: 5379 - protein, 120 aa, Artificial Sequence; identical to SEQ ID NO: 5234
  Description of Artificial Sequence: Synthetic polypeptide

SEQ ID NO: 5380 - protein, 122 aa, Artificial Sequence; identical to SEQ ID NO: 5235
  Description of Artificial Sequence: Synthetic polypeptide

SEQ ID NO: 5381 - protein, 129 aa, Artificial Sequence; identical to SEQ ID NO: 5236
  Description of Artificial Sequence: Synthetic polypeptide

SEQ ID NO: 5382 - protein, 126 aa, Artificial Sequence; identical to SEQ ID NO: 5237
  Description of Artificial Sequence: Synthetic polypeptide

SEQ ID NO: 5383 - protein, 125 aa, Artificial Sequence; identical to SEQ ID NO: 5238
  Description of Artificial Sequence: Synthetic polypeptide

SEQ ID NO: 5384 - protein, 127 aa, Artificial Sequence; identical to SEQ ID NO: 5239
  Description of Artificial Sequence: Synthetic polypeptide

SEQ ID NO: 5385 - protein, 127 aa, Artificial Sequence; identical to SEQ ID NO: 5240
  Description of Artificial Sequence: Synthetic polypeptide

SEQ ID NO: 5386 - protein, 126 aa, Artificial Sequence; identical to SEQ ID NO: 5241
  Description of Artificial Sequence: Synthetic polypeptide

SEQ ID NO: 5387 - protein, 129 aa, Artificial Sequence; identical to SEQ ID NO: 5242
  Description of Artificial Sequence: Synthetic polypeptide

SEQ ID NO: 5388 - protein, 119 aa, Artificial Sequence; identical to SEQ ID NO: 5243
  Description of Artificial Sequence: Synthetic polypeptide

SEQ ID NO: 5389 - protein, 123 aa, Artificial Sequence; identical to SEQ ID NO: 5244
  Description of Artificial Sequence: Synthetic polypeptide

SEQ ID NO: 5390 - protein, 118 aa, Artificial Sequence; identical to SEQ ID NO: 5245
  Description of Artificial Sequence: Synthetic polypeptide

SEQ ID NO: 5391 - protein, 126 aa, Artificial Sequence; identical to SEQ ID NO: 5246
  Description of Artificial Sequence: Synthetic polypeptide

SEQ ID NO: 5392 - protein, 130 aa, Artificial Sequence; identical to SEQ ID NO: 5247
  Description of Artificial Sequence: Synthetic polypeptide

SEQ ID NO: 5393 - protein, 123 aa, Artificial Sequence; identical to SEQ ID NO: 5248
  Description of Artificial Sequence: Synthetic polypeptide

SEQ ID NO: 5394 - protein, 126 aa, Artificial Sequence; identical to SEQ ID NO: 5249
  Description of Artificial Sequence: Synthetic polypeptide

SEQ ID NO: 5395 - protein, 123 aa, Artificial Sequence; identical to SEQ ID NO: 5250
  Description of Artificial Sequence: Synthetic polypeptide

SEQ ID NO: 5396 - protein, 126 aa, Artificial Sequence; identical to SEQ ID NO: 5251
  Description of Artificial Sequence: Synthetic polypeptide

SEQ ID NO: 5397 - protein, 128 aa, Artificial Sequence; identical to SEQ ID NO: 5252
  Description of Artificial Sequence: Synthetic polypeptide

SEQ ID NO: 5398 - protein, 119 aa, Artificial Sequence; identical to SEQ ID NO: 5253
  Description of Artificial Sequence: Synthetic polypeptide

SEQ ID NO: 5399 - protein, 126 aa, Artificial Sequence; identical to SEQ ID NO: 5254
  Description of Artificial Sequence: Synthetic polypeptide

SEQ ID NO: 5400 - protein, 131 aa, Artificial Sequence; identical to SEQ ID NO: 5255
  Description of Artificial Sequence: Synthetic polypeptide

SEQ ID NO: 5401 - protein, 123 aa, Artificial Sequence; identical to SEQ ID NO: 5256
  Description of Artificial Sequence: Synthetic polypeptide

SEQ ID NO: 5402 - protein, 129 aa, Artificial Sequence; identical to SEQ ID NO: 5257
  Description of Artificial Sequence: Synthetic polypeptide

SEQ ID NO: 5403 - protein, 125 aa, Artificial Sequence; identical to SEQ ID NO: 5258
  Description of Artificial Sequence: Synthetic polypeptide

SEQ ID NO: 5404 - protein, 127 aa, Artificial Sequence; identical to SEQ ID NO: 5259
  Description of Artificial Sequence: Synthetic polypeptide

SEQ ID NO: 5405 - protein, 123 aa, Artificial Sequence; identical to SEQ ID NO: 5260
  Description of Artificial Sequence: Synthetic polypeptide

SEQ ID NO: 5406 - protein, 124 aa, Artificial Sequence; identical to SEQ ID NO: 5261
  Description of Artificial Sequence: Synthetic polypeptide

SEQ ID NO: 5407 - protein, 125 aa, Artificial Sequence; identical to SEQ ID NO: 5262
  Description of Artificial Sequence: Synthetic polypeptide

SEQ ID NO: 5408 - protein, 126 aa, Artificial Sequence; identical to SEQ ID NO: 5263
  Description of Artificial Sequence: Synthetic polypeptide

SEQ ID NO: 5409 - protein, 125 aa, Artificial Sequence; identical to SEQ ID NO: 5264
  Description of Artificial Sequence: Synthetic polypeptide

SEQ ID NO: 5410 - protein, 120 aa, Artificial Sequence; identical to SEQ ID NO: 5265
  Description of Artificial Sequence: Synthetic polypeptide

SEQ ID NO: 5411 - protein, 122 aa, Artificial Sequence; identical to SEQ ID NO: 5266
  Description of Artificial Sequence: Synthetic polypeptide

SEQ ID NO: 5412 - protein, 130 aa, Artificial Sequence; identical to SEQ ID NO: 5223
  Description of Artificial Sequence: Synthetic polypeptide

SEQ ID NO: 5413 - protein, 122 aa, Artificial Sequence; identical to SEQ ID NO: 5267
  Description of Artificial Sequence: Synthetic polypeptide

SEQ ID NO: 5414 - protein, 119 aa, Artificial Sequence; identical to SEQ ID NO: 5312
  Description of Artificial Sequence: Synthetic polypeptide

SEQ ID NO: 5415 - protein, 118 aa, Artificial Sequence
  Description of Artificial Sequence: Synthetic polypeptide
QVQLVQSGGEVKKPGASVKVSCKVSGYTLTDYYMYWVRQAPGKGLEWMGWIDPENGNTVYDPKFQGRVTMTEDTSTDTAYMELRSLRSEDTAVYYCATYGTSYWFPYWGRGTLVTVSS

SEQ ID NO: 5416 - protein, 118 aa, Artificial Sequence
  Description of Artificial Sequence: Synthetic polypeptide
QVQLVQSGGEVKKPGASVKVSCKVSGYTLTDYYMYWVRQAPGKGLEWMGWIDPENGNTVYDPKFQGRVTMTEDTSTDTAYMELSSLRSEDTAVYYCATYGTSYWFPYWGQGTMVTVSS

SEQ ID NO: 5417 - protein, 118 aa, Artificial Sequence
  Description of Artificial Sequence: Synthetic polypeptide
QVQLVQSGGEVKKPGASVKVSCKVSGYTLTDYYMYWVRQAPGKGLEWMGWIDPENGNTVYDPKFQGRVTMTTDTSTDTAYMELSSLRSEDTAVYYCATYGTSYWFPYWGQGTTVTVSS

SEQ ID NO: 5418 - protein, 118 aa, Artificial Sequence
  Description of Artificial Sequence: Synthetic polypeptide
QVQLVQSGSELKKPGASVKVSCKASGYTFTDYYMYWVRQAPGQGLEWMGWIDPENGNTVYDPKFQGRFVFSLDTSVSTAYLQICSLKAEDTAVYYCARYGTSYWFPYWGRGTLVTVSS

SEQ ID NO: 5419 - protein, 118 aa, Artificial Sequence
  Description of Artificial Sequence: Synthetic polypeptide
QVQLVQSGSELKKPGASVKVSCKASGYTFTDYYMYWVRQAPGSGLEWMGWIDPENGNTVYDPKFQGRFVFSLDTSVSTAYLQIASLKAEDTAVYYCARYGTSYWFPYWGQGTTVTVSS

SEQ ID NO: 5420 - protein, 118 aa, Artificial Sequence
  Description of Artificial Sequence: Synthetic polypeptide
QVQLVQSGAEVKKPGASVKVSCKASGYTFTDYYMYWVRQAPGQGLEWMGWIDPENGNTVYDPKFQGRVTMTTDTSTSTAYMELRSLRSDDTAVYYCARYGTSYWFPYWGRGTLVTVSS

SEQ ID NO: 5421 - protein, 118 aa, Artificial Sequence
  Description of Artificial Sequence: Synthetic polypeptide
QVQLVQSGAEVKKPGASVKVSCKASGYTFTDYYMYWVRQAPGQGLEWMGWIDPENGNTVYDPKFQGRVTMTTDTSTSTAYMELRSLRSDDTAVYYCARYGTSYWFPYWGQGTTVTVAS

SEQ ID NO: 5422 - protein, 137 aa, Artificial Sequence
  Description of Artificial Sequence: Synthetic polypeptide
  MOD_RES (3)..(3): Any amino acid
QVXLQESGPSLVKPSQTLSLTCTVSGFSLSSYSVSWVRQAPGKTLEWLGDASNGGIIYYNPALKSRLGITRDNSKSQVSLSLNTITPEDTATYYCAKCSVGDSGSYACTGRKGEYVDAWGQGLLVTVSSASTTAPKV

SEQ ID NO: 5423 - protein, 141 aa, Artificial Sequence
  Description of Artificial Sequence: Synthetic polypeptide
  MOD_RES (3)..(3): Any amino acid
  MOD_RES (120)..(120): Any amino acid
QVXLQQSGPSLVKPSQTLSLTCTVSGLSLSDHNVGWIRQAPGKALEWLGVIYKEGDKDYNPALKSRLSITKDNSKSQVSLSLSSVTTEDTATYYCATLGCYFVEGVGYDCTYGLQHTTFXDAWGQGLLVTVSSASTTAPKV

SEQ ID NO: 5424 - protein, 126 aa, Artificial Sequence
  Description of Artificial Sequence: Synthetic polypeptide
QVQLQESGPALVKPTQTLTLTCTFSGFSLSTRGMSVNWIRQPPGKALEWLARIDWDDDTFYSASLKTRLSISKDTSKNQVVLRMTNVDPVDTATYFCARASLYDSDSFYLFYHAYWGQGTVVTVSS

SEQ ID NO: 5425 - protein, 126 aa, Artificial Sequence
  Description of Artificial Sequence: Synthetic polypeptide
QVQLQESGPVVVKPTETLTLTCTVSGFSLSNPRMGVTWIRQPPGKALEWLGNIFSSDEKSFSPSLKSRLTTSQDTSRSQVVLSLTNVDPVDTATYYCARVGLYDINAYYLYYLDYWGQGTLVTVSS

SEQ ID NO: 5426 - protein, 127 aa, Artificial Sequence
  Description of Artificial Sequence: Synthetic polypeptide
QVQLVQSESEVKKPGASVTVSCKPSGYTFNTYYIHWVRQAPGQGLEWMGVINPSGGSTTYTQRFQDRVTMTTDTSTNTIYMDLTSLRSDDTAMYYCVRGSNLLPHLWEWKPSHFDSWGQGTLVTVSS

SEQ ID NO: 5427 - protein, 126 aa, Artificial Sequence
  Description of Artificial Sequence: Synthetic polypeptide
QLQLQESGPGLVKPSETLSLTCTVSGGSISSSNYYWGWIRQPPGKGLEWIASIHDSGSIYYNPSLRSRVTISVDTSKNQFSLKLSSVTAADTAVYYCARHLVWFGELRNNWFDPWGQGTLVTVASA

SEQ ID NO: 5428 - protein, 124 aa, Artificial Sequence
  Description of Artificial Sequence: Synthetic polypeptide
QLQLQESGPGLVKPSETLSLTCTVSGDSITSGQYYWAWIRQAPGKGLEWIGSIHYSGSTYQNPSLKSRLTISVDTSRDQISMKLSSVTVAESAVYYCARQQLSLSPVENWFDPWGQGTLVTVSS

SEQ ID NO: 5429 - protein, 124 aa, Artificial Sequence
  Description of Artificial Sequence: Synthetic polypeptide
EEQLVESGGGLVQPGRSLRLSCVGSGLRFEEHAMHWVRQAPGRGLEWVSGISWNSGSVGYADSVKGRFTTSRDNAKDILFLEMNTLRSEDTALYFCAIMVATTKNDFHYYKDVWGKGTTVTVSS

SEQ ID NO: 5430 - protein, 124 aa, Artificial Sequence
  Description of Artificial Sequence: Synthetic polypeptide
QVHLVQSGVEVKKPGASVRVSCKASGYTFATYGITWVRQAPGRGLEWVGWITPYNDRTSYAQIFHGRVTMTTDTSTNTAYMELRSLRSDDTAMYYCARNHCNFYHDFWSGLDYWGQGTLVSVSS

SEQ ID NO: 5431 - protein, 121 aa, Artificial Sequence
  Description of Artificial Sequence: Synthetic polypeptide
QVQLVQSGAEVKKPGSSVKVPCKASGGTFSTYPISWVRQAPGQGLEWMGRIIPDPPMANIAQKFQGRVSFSADKSTTIVYMELSSLRSEDTAVYFCAREILQSPPFAVDVWGQGTMVAVSS

SEQ ID NO: 5432 - protein, 127 aa, Artificial Sequence
  Description of Artificial Sequence: Synthetic polypeptide
QAQLVESGGGVVQPGRSLRLSCAASGFTFSYSGMHWVRQAPGRGLEWLAVISYDGNKMYYADSVKGRFTISRDNSKMTLYLQMNSLRREDTAVYYCAKDGLDYGGDLVYYGMDVWGNGTTVTVSSAS

SEQ ID NO: 5433 - protein, 126 aa, Artificial Sequence
  Description of Artificial Sequence: Synthetic polypeptide
QVQLVQSGPEVKKPGASVRLSCKASGYVFTNYGVSWVRQAPGQGLEWMGWSSPYNGNTYYAQKLKARVTMTTDTSTNTAYMELRSLRSDDTAVYYCGRDMLGVVQAVAGPFDSWGQGTLVTVSSAS

SEQ ID NO: 5434 - protein, 126 aa, Artificial Sequence
  Description of Artificial Sequence: Synthetic polypeptide
QVQLVQSGGEVKRPGASVRVSCKASGYTFINYAISWVRQAPGQGLEWLGWISAYNGNTHYAQKVQDRVTMTTDASTTTAYMELRGLKSDDTAVYSCARLPLLGYSSGWYAFDMWRQGTMVPVSSAS

SEQ ID NO: 5435 - protein, 127 aa, Artificial Sequence
  Description of Artificial Sequence: Synthetic polypeptide
QVQLLQSGAELKKPGASVKVSCQASIDTFSTYYIHWVRQAPGQGLEWLGVINPSGGSTTYAQKFQDRITLTTDTSTRTVYMDLSSLRSEDTAVYYCARVHKGRAEQWQLLHGHFDLWGRGSLVTVSS

SEQ ID NO: 5436 - protein, 126 aa, Artificial Sequence
  Description of Artificial Sequence: Synthetic polypeptide
QLQLQESGPGLVKPSETLSLTCTVSGDSITSGQYYWAWIRQAPGKGLEWIGSIHYSGSTYQNPSLKSRLTISVDTSRDQISMKLSSVTVAESAVYYCAKQQLSLSPVENWFDPWGQGTLVTVSSAS

SEQ ID NO: 5437 - protein, 120 aa, Artificial Sequence
  Description of Artificial Sequence: Synthetic polypeptide
EVQVVESGGGLVQPGGSLRLSCVASGFTFSSYWMHWVRQAPGKGLVWVSRIYSDGSSTTYADSVKGRFTISRDNAKNTLYLQMNSLRAEDTAVYYCVRVLGAAMFDIWGQGTVVTVSSAS

SEQ ID NO: 5438 - protein, 128 aa, Artificial Sequence
  Description of Artificial Sequence: Synthetic polypeptide
QVQLVESGGGVVQPGRSLRLSCEASGFTFSGYAMHWVRQAPAKGLEWVAVISFDGSNNYYADSVKGRFTISRDNSKNMLFLQMNSLRAEDTAVYYCVRPDVIAVAGTALSNPFDLWGLGTMVTVSSAS

SEQ ID NO: 5439 - protein, 122 aa, Artificial Sequence
  Description of Artificial Sequence: Synthetic polypeptide
QVQLVQSGAEVKKPGASVKVSCKASGYSFTGFTMNWVRQATGQGLEWMGLINPFNGNTGYNQKFKGRVTMTRNTSISTAYMELSSLRSEDTAVYYCARSGKSYDYEAWFTYWGQGTLVTVSA

SEQ ID NO: 5440 - protein, 119 aa, Artificial Sequence
  Description of Artificial Sequence: Synthetic polypeptide
EVQLVESGGGLVQPGGSLRLSCAASGFTFSRYVMSWVRQAPGRGLEWVSSITGSGATTYYADSVKGRFTISRDNSKNTVYLQMNRLRAEDTAIYYCANCGRAGQIFDDWGQGTLVTVSS

SEQ ID NO: 5441 - protein, 125 aa, Artificial Sequence
  Description of Artificial Sequence: Synthetic polypeptide
QVQLVQSGAEMKKPGASVKVSCQVAGYTLTELSIHWVRQTPGNGLEWMGGFEPEDGEYIYPQKSQGRVTMTEDTSTGTAYMELRSLRSDDTAVYYCAAEARYCDNSRCSPNFDHWGQGTLVAVSS

SEQ ID NO: 5442 - protein, 123 aa, Artificial Sequence
  Description of Artificial Sequence: Synthetic polypeptide
QVQLVQSGAEVKKPGSSVKVSCKASGDSFNSLAISWVRQAPGQGLEWMGGIIPKFNRRDYAQKFQGRVTITADDSASTAYIELSSLTSDDTALYYCARDAEWAAGSDYFFDYWGQGTLVIVSS

SEQ ID NO: 5443 - protein, 126 aa, Artificial Sequence
  Description of Artificial Sequence: Synthetic polypeptide
QVQLMESGGGVVQPGKSLRLSCAASGFTFSHYGMHWVRQAPGKGLEWVAVISYDGDKKYYADSVKGRFTISRDNSKNTLHLHMNSLRHEDTAVYFCASQGAKGGHELSFYCALDVWGQGTTVAVSS

SEQ ID NO: 5444 - protein, 123 aa, Artificial Sequence
  Description of Artificial Sequence: Synthetic polypeptide
EVQLVESGGGLVQPGGSLRLSCAASGFTFSTYWVSWVRQTPGKGLEWVARFTISNINQDGSEKSYVDSVEGRDNAKNSLYLQMNSLRADDTAVYYCAREVFVTQVEPAQWGFWGQGTPVIVSS

SEQ ID NO: 5445 - protein, 123 aa, Artificial Sequence
  Description of Artificial Sequence: Synthetic polypeptide
QVQVVQSGAEVKKPGASVKVSCKTSGYNFIDHSVSWVRQAPGQGLEWMGWISPYNHRTVYAEKFQGRVTMTTDTSTRTVSMELRRLTSDDTAVYFCARDRVQQGEGNFFDHWGQGTPVTVTSA

SEQ ID NO: 5446 - protein, 126 aa, Artificial Sequence
  Description of Artificial Sequence: Synthetic polypeptide
QLQLQESGSRLVKPSQTLSLTCGVSGGSISSGGYSWNWIRQPPGKGLEWVGYIYQNDITYYNPSLMSRVTISADTSKNQFSLKLSSVTAADTAVYYCARGAYGSGTYYSADALDIWGQGTMVTVSS

SEQ ID NO: 5447 - protein, 115 aa, Artificial Sequence
  Description of Artificial Sequence: Synthetic polypeptide
QVQLVQSGPEVKKPGASVRLSCTASGNTFRTYAVHWVRQASGQRLEWMGWINPDNGDTKYSQRFQGRVVITRDTSARIIYLDLSSLTSEDTAVFYCFSGRIFDIWGQGTTITVSS

SEQ ID NO: 5448 - protein, 126 aa, Artificial Sequence
  Description of Artificial Sequence: Synthetic polypeptide
QVQLVESGGGVVQPGMSHRLSCAASTLIFDRHALHWVRQAPGAGLEWVAILSYDGTTDYYADSVKGRFTVSRDTSKNTVFLQMNGLRPQDTAVYYCARGRALDDFADYGGYYFDYWGQGILVTVSS

SEQ ID NO: 5449 - protein, 119 aa, Artificial Sequence
  Description of Artificial Sequence: Synthetic polypeptide
QVQLQESGPGLVQPSETLSLTCTVSGDSITSNVYYWGWIRQPPGKGLEWIGSIFHSGITHYTPSLNSRVTISVDTSKNQFSLRLSSATAADTAVYYCARHWAGLYFDSWGQGALVAVSS

SEQ ID NO: 5450 - protein, 124 aa, Artificial Sequence
  Description of Artificial Sequence: Synthetic polypeptide
QVQVVQSGPEVKKPGASVRVSCKASGYTFTNYGVSWVRQAPGQGLEWMGWISTYNGNTWYSQKFQARVTMTTDTSTSTAYMEVRSLRSDDTAIYYCACHGSGNYYGEANYFDHWGQGTLVTVSS

SEQ ID NO: 5451 - protein, 123 aa, Artificial Sequence
  Description of Artificial Sequence: Synthetic polypeptide
QVQLQASGPGLVKPSETLSLTCNVSGYSVSSGHYWAWVRQSPGKGLEWIGGIHHSGSTYTNPPLKSRVSISIDTSKNQFSLRLTSVTAADTAVYFCARDLYDLSTGPFWFDPWGQGTLVTVSS

SEQ ID NO: 5452 - protein, 121 aa, Artificial Sequence
  Description of Artificial Sequence: Synthetic polypeptide
QVHLVQSGAEVKKPGSSVKVSCKASGGTFNGHAISWIRQAPGQGLEWKGGIIPGLGTTRYARKFQDRVTITADESTRTAYMELSSLRSEDTAVYYCARVAGGYFDSATRGWGQGTLVTVSS

SEQ ID NO: 5453 - protein, 123 aa, Artificial Sequence
  Description of Artificial Sequence: Synthetic polypeptide
QVQLVQSGGEVKKPGASVKVSCKASGYTFTNYGICWVRQAPGQGLEWMGWISGYNGNTYYAQNFQGRVTMTTDTSTSTAYMELRSLRSDDTAVYYCARGFHYHSADQRIFDPWGQGTLVTVSS

SEQ ID NO: 5454 - protein, 124 aa, Artificial Sequence
  Description of Artificial Sequence: Synthetic polypeptide
QVLLVQSGAEIKKPGSSVKISCKASGGTFSSLALNWVRQAPGQGLQWMGGIIPLFGTQNYAQKFQGRVTITADESTSTAYMELSGLRPEDTAVYYCALFLWFGDQTSDDGFDVWGQGTVVTVSS

SEQ ID NO: 5455 - protein, 127 aa, Artificial Sequence
  Description of Artificial Sequence: Synthetic polypeptide
QVQLVQSGTEVKKPGASVKVSCKASGYTFSNYGISWVRQAPGQGLEWMGWISAYNGNTYYRQELQGRVTMTTDTSTSTAYMELRSLRSDDTAVYYCARGGAQEMVRIHYYYYGMDVWGQGTTVTVSS

SEQ ID NO: 5456 - protein, 127 aa, Artificial Sequence
  Description of Artificial Sequence: Synthetic polypeptide
QVQLVQSGAEVKKPGASMTVSCKASGYTFSKYGINWVRQAPGQGLEWLGWISAYNGNTYYAQKFQGRVTMTTDTATSTAYMDVRNLRSDDTAMYYCARPATSYDDLRSGYLNYCDYWGQGTLVTVSS

SEQ ID NO: 5457 - protein, 126 aa, Artificial Sequence
  Description of Artificial Sequence: Synthetic polypeptide
EVQLVESGGGLVQPGGSLRLSCVASGFTFSSYAMSWVRQAPGKGLEWVSAIRGSVDNTYYADSVKGRFTISRDNSKNTLYLQMNSLRVEDTAVYYCAKDPALYCSGETCFSDLTDWGQGTLVTVSS

SEQ ID NO: 5458 - protein, 125 aa, Artificial Sequence
  Description of Artificial Sequence: Synthetic polypeptide
QVQLVESGGGVVQPGRSLRLSCAASGFTFSNHGMHWVRQAPGKGLEWVAVISYDGNKKYYADSVKGRFTVSRDNSKNTLSLQMDSLRAEDTAIYYCAKTTFYFDDSNYYEYLDYWGQGTLVTVSS

SEQ ID NO: 5459 - protein, 133 aa, Artificial Sequence
  Description of Artificial Sequence: Synthetic polypeptide
QVQLVESGGGVVQPGRSLRLSCAASGFTFNTHGMHWVRQAPGKGLEWVAVMSYDGTKKYHADSVKGRFTISRDNSKNTLYLQMNSLRVEDTAIYYCAKVGELRSFDWLLADGTAYYYYGMDVWGQGTTVTVSS

SEQ ID NO: 5460 - protein, 120 aa, Artificial Sequence
  Description of Artificial Sequence: Synthetic polypeptide
QVQLVQSGPELRKPGASVTVSCKASGYTFTTYYIHWVRQAPGGGLDWMGMINTGSGVTSYAQKFQGRVAMTRDTSTSTVFMELSSLRFEDTALYYCARMYSGSWYPFDYWGQGALVTVSS

SEQ ID NO: 5461 - protein, 132 aa, Artificial Sequence
  Description of Artificial Sequence: Synthetic polypeptide
QVQLVQSGAEVKKPGASVKVSCKASGYTFTTYGITWVRQAPGQGLEWMGWISGDSDNTNYAQNLQGRVTLTTDISTRTAYMELRSLKPDDTAMYYCARALAKWYCSSSSCFCGGGSCYSDYWGQGTLVTVSS

SEQ ID NO: 5462 - protein, 126 aa, Artificial Sequence
  Description of Artificial Sequence: Synthetic polypeptide
QVQLQESGPRLVKPSETLSLTCTVSGGSTSSYFWNWIRQPPGKGLEWIGYIYGSGSADYNPSLKSRVTISIDTSKTQFSLKLTSVTAADTAVYYCARSGFCTNDACYRRGSWFDPWGQGTLVTVSS

SEQ ID NO: 5463 - protein, 121 aa, Artificial Sequence
  Description of Artificial Sequence: Synthetic polypeptide
QVQLVESGGGWQPGGSLRLSCEASGFMFSVYAIHWVRQAPGKGLEWVAVIWHDGSNKYYADSVKGRFTISRDNSKDTMYLQMKTLRVDDTAVYYCARDPIVGSKTDGMDVWGQGTTVTVSS

SEQ ID NO: 5464 - protein, 121 aa, Artificial Sequence
  Description of Artificial Sequence: Synthetic polypeptide
QVQLVESGGGWQPGRSLRLSCSASGFTFSVYAMHWVRQAPGQGLEWVAIIWYDGSNKYYADSVKGRFTISRDNSKETLYLQMNSLRVEDTAVYYCARDPIVGHTRDGLDVWGQGTTVTVSS

SEQ ID NO: 5465 - protein, 132 aa, Artificial Sequence
  Description of Artificial Sequence: Synthetic polypeptide
QVQLVQSGAEVKKPGASVQVSCKTSGYTFSSYGISWVRQAPGQGPEWMGWISTHIGTTNYAQKLQGRVTMTTDTSTTTAYMELRSLRSDDTAVYYCARDLAKWYCSGDTCFCSGGRCYSDHWGQGTLVTVSS

SEQ ID NO: 5466 - protein, 122 aa, Artificial Sequence
  Description of Artificial Sequence: Synthetic polypeptide
QVQLVQSGAEMKRPGSSVKVSCKASGGTFSTFAINWVRQAPGQGFEWMGGVIPGFDSANYAQKFQGRLTMSADESTSTVYMELSSLRSDDTAVYYCAGNSGYCSGDSCAPNWGPGTLVTVSS

SEQ ID NO: 5467 - protein, 130 aa, Artificial Sequence
  Description of Artificial Sequence: Synthetic polypeptide
EVQLVESGGGLVQPGGSLRLSCAASGFSFSNYAMSWVRQAPGKGLEWVSDISGSGNSTNFADSVKGRFTISRDNSKNTLYLQMSSLRAEDTAVYYCAKFRVPTYCVNGICYQGLPGFDIWGQGTMVTVSS

SEQ ID NO: 5468 - protein, 130 aa, Artificial Sequence
  Description of Artificial Sequence: Synthetic polypeptide
EVQLVESGGGLVQPGGSLRLSCAASGFNFSNYAMSWVRQAPGKGLEWVSDISSSGKTTNSADSVKGRFTISRDNSKNTLFLQMSSLRADDTAVYYCAKFRVPTYCVNGICYQGLPGFDIWGQGTMVTVSS

SEQ ID NO: 5469 - protein, 123 aa, Artificial Sequence
  Description of Artificial Sequence: Synthetic polypeptide
QVQLVESGGGVVQPGRSLRLSCAASGFTFSNYGMHWVRQAPGKGLEWVTIISYDESTTLYADSVKGRFTISRDNSKNTVYLQMNSLRPEDTAVYYCARDHFDPSGYFWYFDLWGRGTLVTVSS

SEQ ID NO: 5470 - protein, 128 aa, Artificial Sequence
  Description of Artificial Sequence: Synthetic polypeptide
QVQLVQSGAEVKKPGSSVRVSCKASGGTFSRYVITWVRQAPGQGLEWMGGSIPIIDTSTYAQKFQDRVTITADKSTSTVYLELSSLRPEDTAIYYCAKVFFFSNSSGPPTEGPAFDVWGQGTMVTVSS

SEQ ID NO: 5471 - protein, 121 aa, Artificial Sequence
  Description of Artificial Sequence: Synthetic polypeptide
QLQLQESGPGLVKPSETLSLTCTVSGGSISSNIHYWAWIRQTPGKGLEWIGYMFYGGVAFYNPSLKSRVAISVDTSKNQFSLRLTSASAADTAVYYCARVLVASTNWFDPWGQGTLVTVSS

SEQ ID NO: 5472 - protein, 125 aa, Artificial Sequence
  Description of Artificial Sequence: Synthetic polypeptide
QVQLVESGGGWQPGRSLRLSCAASGFTFYNYAVHWVRQAPGKGLEWVAVISHDGVNKDYADSVKGRITLSRDNSKNTVYLQLNSLRPEDTAVYYCARDRSYYFGGSVFHLYFDYWGQGTLVTVSS

SEQ ID NO: 5473 - protein, 129 aa, Artificial Sequence
  Description of Artificial Sequence: Synthetic polypeptide
QVQLVQSGAEVKKPGSSVKVSCKTSGDTFSNYWSWVRQAPGQGLEWMGGIIPMFGTTNYAQRFQGRVTISADESTSTAYMEMSSLKSEDTAVYYCARDRYYEVRAGGKVLNTYYYMDVWGKGTTVTVSS

SEQ ID NO: 5474 - protein, 121 aa, Artificial Sequence
  Description of Artificial Sequence: Synthetic polypeptide
EVQLVESGGDLVQPGGSLRLSCSASGFVFTSYSFHWVRQAPGKGLEYVSSVSADGGSTYYADSVRGRFLISRDNSKNTLSLQMSSLRPDDTALYYCVPQPSLLWFGDLRSWGQGTLVTVSS

SEQ ID NO: 5475 - protein, 123 aa, Artificial Sequence
  Description of Artificial Sequence: Synthetic polypeptide
EVQLVESGGGVVQPGRSLRLSCAASGFSFSHYAMHWVRQAPGKGLEWVAVISYDGENTYYADSVKGRFSISRDNSKNTVSLQMNSLRPEDTALYYCARDRIVDDYYYYGMDVWGQGATVTVSS

SEQ ID NO: 5476 - protein, 125 aa, Artificial Sequence
  Description of Artificial Sequence: Synthetic polypeptide
EVQLVETGGGLAQPGGSLRLSCAASGFTFSSYNMNWVRQAPGKGLEWVSHISAGSSYIYYSDSVKGRFTVSRDNVRNSVYLQMNSLRAADTAVYYCAREDYGPGNYYSPNWFDPWGQGTLVTVSS

SEQ ID NO: 5477 - protein, 120 aa, Artificial Sequence
  Description of Artificial Sequence: Synthetic polypeptide
EVQLVESGGNVVKPGTSLRLSCAATGFNFHNYGMNWVRQAPGKGLEWVAVVWYDGSKKYYADSVTGRFAISRDNSKNTLYLQMNSLRVEDTAVYYCVRDKVGPTPYFDSWGQGTLVTVSS

SEQ ID NO: 5478 - protein, 126 aa, Artificial Sequence [sequence omitted]

SEQ ID NO: 5479 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARSMITNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5480 - protein, 450 aa, Artificial Sequence; identical to SEQ ID NO: 5287
  Description of Artificial Sequence: Synthetic polypeptide

SEQ ID NO: 5481 - protein, 450 aa, Artificial Sequence; identical to SEQ ID NO: 5287
  Description of Artificial Sequence: Synthetic polypeptide

SEQ ID NO: 5482 - protein, 450 aa, Artificial Sequence; identical to SEQ ID NO: 5286
  Description of Artificial Sequence: Synthetic polypeptide

SEQ ID NO: 5483 - protein, 450 aa, Artificial Sequence; identical to SEQ ID NO: 5283
  Description of Artificial Sequence: Synthetic polypeptide

SEQ ID NO: 5484 - protein, 450 aa, Artificial Sequence; identical to SEQ ID NO: 5280
  Description of Artificial Sequence: Synthetic polypeptide

SEQ ID NO: 5485 - protein, 450 aa, Artificial Sequence; identical to SEQ ID NO: 5281
  Description of Artificial Sequence: Synthetic polypeptide

SEQ ID NO: 5486 - protein, 450 aa, Artificial Sequence; identical to SEQ ID NO: 5281
  Description of Artificial Sequence: Synthetic polypeptide

SEQ ID NO: 5487 - protein, 450 aa, Artificial Sequence; identical to SEQ ID NO: 5284
  Description of Artificial Sequence: Synthetic polypeptide

SEQ ID NO: 5488 - protein, 450 aa, Artificial Sequence; identical to SEQ ID NO: 5285
  Description of Artificial Sequence: Synthetic polypeptide

SEQ ID NO: 5489 - protein, 451 aa, Artificial Sequence; identical to SEQ ID NO: 5333
  Description of Artificial Sequence: Synthetic polypeptide

SEQ ID NO: 5490 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARDMIFNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5491 - protein, 450 aa, Artificial Sequence; identical to SEQ ID NO: 5490
  Description of Artificial Sequence: Synthetic polypeptide

SEQ ID NO: 5492 - protein, 450 aa, Artificial Sequence; identical to SEQ ID NO: 5490
  Description of Artificial Sequence: Synthetic polypeptide

SEQ ID NO: 5493 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARDMITNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5494 - protein, 450 aa, Artificial Sequence; identical to SEQ ID NO: 5479
  Description of Artificial Sequence: Synthetic polypeptide

SEQ ID NO: 5495 - protein, 450 aa, Artificial Sequence; identical to SEQ ID NO: 5493
  Description of Artificial Sequence: Synthetic polypeptide

SEQ ID NO: 5496 - protein, 450 aa, Artificial Sequence; identical to SEQ ID NO: 5493
  Description of Artificial Sequence: Synthetic polypeptide

SEQ ID NO: 5497 - protein, 450 aa, Artificial Sequence; identical to SEQ ID NO: 5493
  Description of Artificial Sequence: Synthetic polypeptide

SEQ ID NO: 5498 - protein, 450 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARSMITNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5499 - protein, 450 aa, Artificial Sequence; identical to SEQ ID NO: 5283
  Description of Artificial Sequence: Synthetic polypeptide

SEQ ID NO: 5500 - protein, 450 aa, Artificial Sequence; identical to SEQ ID NO: 5284
  Description of Artificial Sequence: Synthetic polypeptide

SEQ ID NO: 5501 - protein, 450 aa, Artificial Sequence; identical to SEQ ID NO: 5284
  Description of Artificial Sequence: Synthetic polypeptide

SEQ ID NO: 5502 - protein, 450 aa, Artificial Sequence; identical to SEQ ID NO: 5284
  Description of Artificial Sequence: Synthetic polypeptide

SEQ ID NO: 5503 - protein, 10 aa, Artificial Sequence
  Description of Artificial Sequence: Synthetic peptide
APIAPPYFDH

SEQ ID NO: 5504 - protein, 16 aa, Artificial Sequence
  Description of Artificial Sequence: Synthetic peptide
HLPDYWNLDYTRFFYY

SEQ ID NO: 5505 - protein, 126 aa, Artificial Sequence
  Description of Artificial Sequence: Synthetic polypeptide
QVQLVQSGAEVKKPGSSVMVSCQASGGPLRNYIINWVRQAPGQGPEWMGGIIPVLGTVHYAPKFQGRVTITADESTDTAYMELSSLRSEDTAMYYCATETALVVSTTYLPHYFDNWGQGTLVTVSS

SEQ ID NO: 5506 - protein, 126 aa, Artificial Sequence
  Description of Artificial Sequence: Synthetic polypeptide
QVQLVQSGAEVKKPGSSVMVSCQASGGPLRNYIINWVRQAPGQGLEWMGGIIPVLGTVHYAPKFQGRVTITADESTDTAYMELSSLRSEDTAMYYCATETALVVSTTYLPHYFDNWGQGTLVTVSS

SEQ ID NO: 5507 - protein, 126 aa, Artificial Sequence
  Description of Artificial Sequence: Synthetic polypeptide
QVQLVQSGAEVKKPGSSVKVSCKASGGTFSNYIINWVRQAPGQGLEWMGGIIPVLGTVHYAPKFQGRVTITADESTDTAYMELSSLRSEDTAMYYCATETALVVSTTYLPHYFDNWGQGTLVTVSS

SEQ ID NO: 5508 - protein, 126 aa, Artificial Sequence
  Description of Artificial Sequence: Synthetic polypeptide
QVQLVQSGAEVKKPGSSVMVSCQASGGLLEDYIINWVRQAPGQGPEWMGGIIPVLGTVHYGPKFQGRVTITADESTDTAYMELSSLRSEDTAMYYCATETALVVSTTYLPHYFDNWGQGTLVTVSS

SEQ ID NO: 5509 - protein, 126 aa, Artificial Sequence
  Description of Artificial Sequence: Synthetic polypeptide
QVQLVQSGAEVKKPGSSVMVSCQASGGPLEDYIINWVRQAPGQGPEWMGGIIPVLGTVHYGPKFQGRVTITADESTDTAYMELSSLRSEDTAMYYCATETALVVSTTYLPHYFDNWGQGTLVTVSS

SEQ ID NO: 5510 - protein, 126 aa, Artificial Sequence
  Description of Artificial Sequence: Synthetic polypeptide
QVQLVQSGAEVKKPGSSVMVSCQASGGPLEDYIINWVRQAPGQGPEWMGGIIPVLGTVHYGPKFQGRVTITADESTDTAYMELSSLRSEDTAMYYCATETALVVSTTYRPHYFDNWGQGTLVTVSS

SEQ ID NO: 5511 - protein, 126 aa, Artificial Sequence
  Description of Artificial Sequence: Synthetic polypeptide
QVQLVQSGAEVKKPGSSVKVSCKASGGLLEDYIINWVRQAPGQGPEWMGGIIPVLGTVHYGPKFQGRVTITADESTSTAYMHLSSLRSEDTAMYYCARETALVVSTTYLPHYFDNWGQGTLVTVSS

SEQ ID NO: 5512 - protein, 126 aa, Artificial Sequence
  Description of Artificial Sequence: Synthetic polypeptide
QVQLVQSGAEVKKPGSSVKVSCKASGGLLEDYIINWVRQAPGQGPEWMGGIIPVLGTVHYGPKFQGRVTITADESTDTAYMHLSSLRSEDTAMYYCATETALVVSTTYLPHYFDNWGQGTLVTVSS

SEQ ID NO: 5513 - protein, 126 aa, Artificial Sequence
  Description of Artificial Sequence: Synthetic polypeptide
QVQLVQSGAEVKKPGSSVKVSCKASGGLLEDYIINWVRQAPGQGPEWMGGIIPVLGTVHYGPKFQGRVTITADESTSTAYMELSSLRSEDTAMYYCATETALVVSTTYLPHYFDNWGQGTLVTVSS

SEQ ID NO: 5514 - protein, 126 aa, Artificial Sequence
  Description of Artificial Sequence: Synthetic polypeptide
QVQLVQSGAEVKKPGSSVKVSCKASGGLLEDYIINWVRQAPGQGPEWMGGIIPVLGTVHYGPKFQGRVTITADESTSTAYMHLSSLRSEDTAMYYCATETALVVSTTYLPHYFDNWGQGTLVTVSS

SEQ ID NO: 5515 - protein, 120 aa, Artificial Sequence; identical to SEQ ID NO: 5274
  Description of Artificial Sequence: Synthetic polypeptide

SEQ ID NO: 5516 - protein, 120 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARSMITNFYFDVWGAGTTVTVSS

SEQ ID NO: 5517 - protein, 120 aa, Artificial Sequence; identical to SEQ ID NO: 5338
  Description of Artificial Sequence: Synthetic polypeptide

SEQ ID NO: 5518 - protein, 120 aa, Artificial Sequence; identical to SEQ ID NO: 5339
  Description of Artificial Sequence: Synthetic polypeptide

SEQ ID NO: 5519 - protein, 120 aa, Artificial Sequence; identical to SEQ ID NO: 5340
  Description of Artificial Sequence: Synthetic polypeptide

SEQ ID NO: 5520 - protein, 120 aa, Artificial Sequence; identical to SEQ ID NO: 5340
  Description of Artificial Sequence: Synthetic polypeptide

SEQ ID NO: 5521 - protein, 120 aa, Artificial Sequence; identical to SEQ ID NO: 5342
  Description of Artificial Sequence: Synthetic polypeptide

SEQ ID NO: 5522 - protein, 120 aa, Artificial Sequence; identical to SEQ ID NO: 5279
  Description of Artificial Sequence: Synthetic polypeptide

SEQ ID NO: 5523 - protein, 120 aa, Artificial Sequence; identical to SEQ ID NO: 5279
  Description of Artificial Sequence: Synthetic polypeptide

SEQ ID NO: 5524 - protein, 120 aa, Artificial Sequence [sequence omitted]

SEQ ID NO: 5525 - protein, 120 aa, Artificial Sequence; identical to SEQ ID NO: 5346
  Description of Artificial Sequence: Synthetic polypeptide

SEQ ID NO: 5526 - protein, 120 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARDMIFNWYFDVWGAGTTVTVSS

SEQ ID NO: 5527 - protein, 120 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKDYNPSLKSRLTISKDTSKNQVVLKVTNMDPADTATYYCARDMITNFYFDVWGAGTTVTVSS

SEQ ID NO: 5528 - protein, 120 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNWYFDVWGAGTTVTVSS

SEQ ID NO: 5529 - protein, 120 aa, Artificial Sequence
  Description of Artificial Sequence: Synthetic polypeptide
EVQLLEESGGGLVRPGGSLRLSCAASGTTLSGYTMHWVRQAPGKGLEWVSSITGGSNFINYSDSVKGRFTISRDNAKNSLYLQMNSLTAEDTAVYYCATAPIAPPYFDHWGQGTLVTVSS

SEQ ID NO: 5530 - protein, 119 aa, Artificial Sequence
  Description of Artificial Sequence: Synthetic polypeptide
EVQLLESGGGLVRPGGSLRLSCAASGTTLSGYTMHWVRQAPGKGLEWVSSITGGSNFINYSDSVKGRFTISRDNAKNSLYLQMNSLTAEDTAVYYCATAPIAPPYFDHWGQGTLVTVSS

SEQ ID NO: 5531 - protein, 121 aa, Artificial Sequence [sequence omitted]

SEQ ID NO: 5532 - protein, 121 aa, Artificial Sequence
  Description of Artificial Sequence: Synthetic polypeptide
QVQLVESGGGLVQPGRSLRLSCAASGFTFDDYAMHWVRQAPGKGLDWVSAITWNSGHIDYADSVEGRFAVSRDNAKNALYLQMNSLRPEDTAVYYCTKASYLSTSSSLDNWGQGTLVTVSS

SEQ ID NO: 5533 - protein, 220 aa, Artificial Sequence
  Description of Artificial Sequence: Synthetic polypeptide
EVQLLESGGGLVQPGGSRRLSCAASGFTVSSSYMSWVRQTPGKGLEWISVFYSGGTTYYADAVKGRFSISMDTSKNTLHLQMNSLRVEDTAIYYCARVLSRASGMPDAFDIWGPGTMVTVSSASTKGPSVFPLAPSSAATSGGTAALGCLVKDYFPEPVTVSWNSGALTSGVHTFPAVLQSSGLYSLSSVVTVPSSSLGTQTYICNVNHKPSNTKVDKKV

SEQ ID NO: 5534 - protein, 140 aa, Artificial Sequence
  Description of Artificial Sequence: Synthetic polypeptide
MKLGFSWIFLVLVLKGVQCEIILVESGGGLVRPGGSLKLSCAASGFTFSHYAMSWARQTPEKRLEWVATINSGGSYTYYPDSVKGRFTISRDNAKNSLYLQMSSLRSEDTAMYYCARKGAMDYWGQGTSVTVSSAKTTAP

SEQ ID NO: 5535 - protein, 127 aa, Artificial Sequence
  Description of Artificial Sequence: Synthetic polypeptide
QVQLVESGGGVVQPGRPLRLSCAASGFAFNNFALHWVRQAPGKGPEWLAAVSYDGTSPYYAESVRARFSISRDNSKKTFYLQLDSLRPEDTAVYYCARGLGSGSYSWIGYFYAMDVWGRGITVTVSS

SEQ ID NO: 5536 - protein, 128 aa, Artificial Sequence
  Description of Artificial Sequence: Synthetic polypeptide
QVTLKESGPVLVKPSETLTLTCTVSGFSLTDARMGVSWIRQPPGKALEWLAHIFSNDEKFYSTSLKTRLTISKDTSTSQVVLRMTNMDPVDTATYYCARVDQGWVNTYSAFYYGMDFWGQGTTVTVSS

SEQ ID NO: 5537 - protein, 123 aa, Artificial Sequence
  Description of Artificial Sequence: Synthetic polypeptide
  MOD_RES (50)..(50): Ile or Leu
QVQLQESGPGLVKPSQTLSLTCTVSGGSISSGDYYWSWIRQPPGKGLEWXGYIYFSGSTYYNPSLKSRVTMSGDTSKNQFSLRLSSVTAADTAVYYCAREDTTMAIPYYFDPWGRGILVTVSS

SEQ ID NO: 5538 - protein, 128 aa, Artificial Sequence
  Description of Artificial Sequence: Synthetic polypeptide
QVTLKESGPVLVKPTETLTLTCTVSGFSLTDARMGVSWIRQPPGKALEWLAHIFSNDEKSYSTSLKSRLTISKDTSKSQVVLTMTNMDPVDTATYYCARVDQGWVNTYSAFYYGMDFWGQGTTVTVSS

SEQ ID NO: 5539 - protein, 224 aa, Artificial Sequence
  Description of Artificial Sequence: Synthetic polypeptide
QVQLVQSGPGLVKPSQTLALTCNVSGASINSDYYWTWIRQRPGGGLEWIGHISYTGNTYYTPSLSRLSMSLETSQSQFSLRLTSVTAADSAVYFCAACGAYVLISNCGWFDSWGQGTQVTVSSASTKGPSVFPLAPSSKSTSGGTAALGCLVKDYFPEPVTVSWSGALTSGVHTFPAVLQSSGLYSLSSWTVPSSSLGTQTYICNVNHKPSNTKVDKKVEPKSC

SEQ ID NO: 5540 - protein, 220 aa, Artificial Sequence
  Description of Artificial Sequence: Synthetic polypeptide
EVQLLQSGAELKPGASVKISCKTSGFTFSGHTIAWVRQAPGQGLEWMGWVSTNGNTEYAQKIQGRVTMTMDTSTSTVYMELRSLTSDDTAVYFCAREWLVMGGFAFDHWGQGTLLTVSSASTKGPSVFPLAPSSKSTSGGTAALGCLVKDYFPEPVTVSWNSGALTSGVHTFPAVLQSSGLYSLSSWTVPSSSLGTQTYICNVHKPSNTKVDKRVEPKSC

SEQ ID NO: 5541 - protein, 128 aa, Artificial Sequence
  Description of Artificial Sequence: Synthetic polypeptide
EVQLVQSGAEVKKPGTSLKISCKGSGFSFSNYWIGWVRQMPGKGLEWMGIVYPADSDTRYSPSFQGQVTISGDNSINTAYLQWSRLKASDTATYYCVRQIGGVVTIATDDYFYGMDIWGPGTIVIVSS

SEQ ID NO: 5542 - protein, 128 aa, Artificial Sequence
  Description of Artificial Sequence: Synthetic polypeptide
EVQLVQSGAEVKKPGTSLKISCKGSGFSFSNYWIGWVRQMPGKGLEWMGIVYPADSDTRYSPSFQGQVTISGDNSINTAYLQWSRLKASDTATYYCVRQIGGVVTIATDDYFYGMDIWGPGTTVTVSS

SEQ ID NO: 5543 - protein, 127 aa, Artificial Sequence
  Description of Artificial Sequence: Synthetic polypeptide
QVQLVESGGGVVQPGRSLRLSCAASGFAFNNFAMHWVRQAPGKGLEWVAVVSYDGTSPYYADSVKGRFTISRDNSKNTLYLQMNSLRAEDTAVYYCARGLGSGSYSWIGYFYAMDVWGQGTTVTVSS

SEQ ID NO: 5544 - protein, 216 aa, Artificial Sequence
  Description of Artificial Sequence: Synthetic polypeptide
EIVLTQSPATLSLSPGERATLSCRASQSVNSHLAWYQQKPGQAPRLLIYNTFNRVTGIPARFSGSGSGTDFTLTISSLATEDFGVYYCQQRSNWPPALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5545 - protein, 215 aa, Artificial Sequence
  Description of Artificial Sequence: Synthetic polypeptide
DIQMTQSPSSLSASVGDRVTFTCRASQRISNHLNWYQQKPGKAPKLLIFGASTLQSGAPSRFSGSGSGTDFTLTITNVQPDDFATYYCQQSYRTPPINFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5546 - protein, 217 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYDSSLSTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5547 - protein, 213 aa, Artificial Sequence
  Description of Artificial Sequence: Synthetic polypeptide
DIQMTQSPSSLSASVGDRVTITCRASQSITGYLNWYQQKPGKAPKLLIYATSTLQSEVPSRFSGSGSGTDFTLTISSLQPEDFATYYCQQSYNTLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5548 - protein, 215 aa, Artificial Sequence
  Description of Artificial Sequence: Synthetic polypeptide
EIVLTQSPGTLSLSPGERATLSCRASQSVSSSYLAWYQQKPGQAPRLLIHGASTGATGTPDRFSGSGSGTDFTLTISTLEPEDFAVYYCQQYGRTPYTFGQGTKLENKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5549 - protein, 219 aa, Artificial Sequence
  Description of Artificial Sequence: Synthetic polypeptide
DIVMTQTPLSLSVTPGQPASISCRSSQSLLRSDGKTFLYWYLQKPGQSPQPLMYEVSSRFSGVPDRFSGSGSGADFTLNISRVETEDVGIYYCMQGLKIRRTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5550 - protein, 215 aa, Artificial Sequence
  Description of Artificial Sequence: Synthetic polypeptide
DIQMTQSPSTLSASVGDRVTFSCRASQSVSSWVAWYQQKPGKAPKLLISEASNLESGVPSRFSGSGSGTEFTLTISSLQPEDFATYYCQQYHSYSGYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5551 - protein, 214 aa, Artificial Sequence
  Description of Artificial Sequence: Synthetic polypeptide
AIQLTQSPSSLSASVGDRVTLTCRASQGITDSLAWYQQKPGKAPKVLLYAASRLESGVPSRFSGRGSGTDFTLTISSLQPEDFATYYCQQYSKSPATFGPGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5552 - protein, 219 aa, Artificial Sequence
  Description of Artificial Sequence: Synthetic polypeptide
DIVMTQSPLSLPVTPGEPASISCRSSQSLLNSNGFNYVDWYLQKPGQSPQLLIYLGSNRASGVPDRFSGSGSGTDFTLKISRVEAEDVGVYYCMQALETPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5553 - protein, 215 aa, Artificial Sequence
  Description of Artificial Sequence: Synthetic polypeptide
EIVLTQSPGTLSLSPGGRATLSCRASQSVSSGYLAWYQQKPGQAPRLLIYGASGRATGIPDRFSGSGSGTDFTLTISRLEPEDFAVYYCQQYFGSPYTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5554 - protein, 214 aa, Artificial Sequence
  Description of Artificial Sequence: Synthetic polypeptide
NIQMTQSPSAMSASVGDRVTITCRASQGISNYLVWFQQKPGKVPKRLIYAASSLQSGVPSRFSGSGSGTEFTLTISSLQPEDFATYYCLQHNISPYTFGQGTKLETKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5555 - protein, 220 aa, Artificial Sequence
  Description of Artificial Sequence: Synthetic polypeptide
DIVMTQSPDSLAVSLGERATINCRSSETVLYTSKNQSYLAWYQQKARQPPKLLLYWASTRESGVPARFSGSGSGTDFTLAISSLQAEDVAVYYCQQFFRSPFTFGPGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5556 - protein, 215 aa, Artificial Sequence
  Description of Artificial Sequence: Synthetic polypeptide
EIVLTQSPGTLSLSPGERVTLSCRASQSVSSSYIAWYQQKPGQAPRLVIYAASRRATGVPDRFSGSGSATDFTLTISRLEPEDLAVYYCQHYGNSLFTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5557 - protein, 215 aa, Artificial Sequence
  Description of Artificial Sequence: Synthetic polypeptide
DIQMTQSPSTLSASVGDRVTITCRASQSIGSRLAWYQQQPGKAPKFLIYDASSLESGVPSRFSGSGSGTEFTLTISSLQPEDLATYYCQQYNRDSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5558 - protein, 219 aa, Artificial Sequence
  Description of Artificial Sequence: Synthetic polypeptide
DIVMTQSPLSLPVTPGEPASISCRSSQSLLHSDGRYYVDWYLQKPGQSPHLLIYLASNRASGVPDRFTGSGSGTDFTLKISRVEAEDVGVYYCMQGLHTPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5559 - protein, 213 aa, Artificial Sequence
  Description of Artificial Sequence: Synthetic polypeptide
EIVMTQSPATLSASPGERATLSCWASQTIGGNLAWYQQKPGQAPRLLIYGASTRATGVPARFSGSGSGTEFTLAISSLQSEDFAVYYCQQYKNWYTFGQGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5560 - protein, 215 aa, Artificial Sequence
  Description of Artificial Sequence: Synthetic polypeptide
DIQMTQSPSSLSASVGDRVTITCRASQTIASYVNWYQQKPGRAPSLLIYAASNLQSGVPPRFSGSGSGTDFTLTISGLQPDDFATYYCQQSYSYRALTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5561 - protein, 216 aa, Artificial Sequence
  Description of Artificial Sequence: Synthetic polypeptide
EIVLTQSPATLSLSPGERATLSCRASQSVSSSLAWYQQTPGQAPRLLIYDASYRVTGIPARFSGSGSGIDFTLTISSLEPEDFAVYYCQQRSNWPPGLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5562 - protein, 214 aa, Artificial Sequence
  Description of Artificial Sequence: Synthetic polypeptide
AIQLTQSPSSLSASVGDTVTVTCRPSQDISSALAWYQQKPGKPPKLLIYGASTLDYGVPLRFSGTASGTHFTLTISSLQPEDFATYYCQQFNTYPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5563 - protein, 220 aa, Artificial Sequence
  Description of Artificial Sequence: Synthetic polypeptide
DIVMTQSPDSLAVSLGERATINCKSSQSVLYNSNNKNYLAWYQQKPGQPPKLLIHLASTREYGVPDRFSGSGSGTDFALIISSLQAEDVAVYYCQQYYQTPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5564 - protein, 214 aa, Artificial Sequence
  Description of Artificial Sequence: Synthetic polypeptide
DIQMTQSPSSLAASVGDRVTITCRASQFISSYLHWYQQRPGKAPKLLMYAASTLQSGVPSRFSGSGSGTDFTLTISSLQPEDFATYYCQQSYTNPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5565 - protein, 214 aa, Artificial Sequence
  Description of Artificial Sequence: Synthetic polypeptide
DIQMTQSPSSLSASVGDRVTITCRASQSIASYLNWYQQKPGKAPKLLIYAASSLHSGVPSRFSGSGSGTDFTLTISSLQPEDFATYYCQHSYSTRFTFGPGTKVDVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5566 - protein, 214 aa, Artificial Sequence
  Description of Artificial Sequence: Synthetic polypeptide
DIQMTQSPSTLSASVGDRVTITCRASQSVTSELAWYQQKPGKAPNFLIYKASSLESGVPSRFSGSGSGTEFTLTISSLQPDDFATYYCQQYNSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5567 - protein, 214 aa, Artificial Sequence
  Description of Artificial Sequence: Synthetic polypeptide
DIQMTQSPSTLSASVGDRLTITCRASQNIYNWLAWYQQKPGKAPKLLIYDASTLESGVPSRFSGSGSGTEFTLTISSLQPDDFATYYCQQYNSLSPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5568 - protein, 214 aa, Artificial Sequence
  Description of Artificial Sequence: Synthetic polypeptide
DIQLTQSPSFLSASLEDRVTITCRASQGISSYLAWYQQKPGKAPKLLLDAASTLQSGVPSRFSGSGSGTEFTLTISSLQPEDFATYYCQQLNSYPRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5569 - protein, 214 aa, Artificial Sequence
  Description of Artificial Sequence: Synthetic polypeptide
DIQMTQSPSSLSASVGDRVSITCRASQGISNYLAWYQQKPGKVPKLLIYAASTLQSGVPSRFSGSGSGTDFTLTISSLQPEDVATYYCQKYNSAPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5570 - protein, 220 aa, Artificial Sequence
  Description of Artificial Sequence: Synthetic polypeptide
DIVMTQSPDSLAVSLGERATINCRSSQSVLYSSNNKNYLAWYQQKPGQPPKLLVYWASTRASGVPDRFSGSGSGTDFTLTLSSLQAEDVAVYYCQQFHSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5571 - protein, 215 aa, Artificial Sequence
  Description of Artificial Sequence: Synthetic polypeptide
EIVLTQSPGTLSLSPGERATLSCRASQSVSSNYLAWYQQKPGQAPRLLIYGASSRAAGMPDRFSGSGSGTDFTLTISRLEPEDFAVYYCQQYGNSPLTFGGGTEVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5572 - protein, 214 aa, Artificial Sequence
  Description of Artificial Sequence: Synthetic polypeptide
DIQMTQSPSSVSASVGDRVTITCRASQAISNWLAWYQQKPGKAPKLLIYAASSLQSGVPSRFSGSGSGTDFTLTISGLQPEDFATYYCQQADTFPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5573 - protein, 220 aa, Artificial Sequence
  Description of Artificial Sequence: Synthetic polypeptide
DIVMTQTPLSLPVTPGEPASISCRSSQSLLDSNDGNTYLDWYLQKPGQSPQLLIYTFSYRASGVPDRFSGSGSGTDFTLKISRVEAEDVGVYYCMQRIEFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5574 - protein, 219 aa, Artificial Sequence
  Description of Artificial Sequence: Synthetic polypeptide
DIVMTQSPLSLPVTPGEPASISCRSSQSLLHRNEYNYLDWYLQKPGQSPQLLIYWGSNRASGVPDRFSGSGSGTDFTLKISRVEAEDVGVYYCMQTLQTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5575 - protein, 214 aa, Artificial Sequence
  Description of Artificial Sequence: Synthetic polypeptide
DIQMTQSPSSVSASVGDRVTITCQASQDISNYLNWYQQKPGKAPKLLIFDATKLETGVPTRFIGSGSGTDFTVTITSLQPEDVATYYCQHFANLPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5576 - protein, 214 aa, Artificial Sequence
  Description of Artificial Sequence: Synthetic polypeptide
DIQMTQSPSSLSASVGDRVTITCRASQGIRNYLAWYQQKPGKVPKLLVFAASTLQSGVPSRFSGSGSGTDFTLTISSLQPEDVATYYCQRYNSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5577 - protein, 215 aa, Artificial Sequence
  Description of Artificial Sequence: Synthetic polypeptide
DIQMTQSPSSLSASVGDRVTITCRASQIIASYLNWYQQKPGRAPKLLIYAASSLQSGVPSRFSGSGSGTDFTLTISSLQPEDFATYYCQQSYSTPIFTFGPGTKVNIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5578 - protein, 213 aa, Artificial Sequence
  Description of Artificial Sequence: Synthetic polypeptide
EIVLTQSPATLSLSPGERATLSCRTSQSVSSYLAWYQQKPGQAPRLLIYDASNRATGIPARFSGSGSGTDFTLTISSLEPEDFAVYYCQQRSDWLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5579 - protein, 215 aa, Artificial Sequence
  Description of Artificial Sequence: Synthetic polypeptide
EIVMTQSPATLSVSPGERATLSCRASQSIKNNLAWYQVKPGQAPRLLTSGASARATGIPGRFSGSGSGTDFTLTISSLQSEDIAVYYCQEYNNWPLLTFGGGTKVEIQRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5580 - protein, 215 aa, Artificial Sequence
  Description of Artificial Sequence: Synthetic polypeptide
DIQMTQSPPSLSASVGDRVTITCRASQRIASYLNWYQQKPGRAPKLLIFAASSLQSGVPSRFSGSGSGTDFTLTISSLQPEDYATYYCQQSYSTPIYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5581 - protein, 214 aa, Artificial Sequence
  Description of Artificial Sequence: Synthetic polypeptide
DIQMTQSPSSLSASVGDRVTITCQASQGISNYLNWYQQKPGKAPKLLIFDASNLESEVPSRFSGRGSGTDFTFSISSLQPEDIATYFCQQYDNFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5582 - protein, 214 aa, Artificial Sequence
  Description of Artificial Sequence: Synthetic polypeptide
DIQMTQSPSSLAASVGDRVTITCRASQTIASYVNWYQQKPGKAPNLLIYAASSLQSGVPSRFSGSGSGTDFTLTISSLQPEDFASYFCQQSYSFPYTFGQGTKLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5583 - protein, 215 aa, Artificial Sequence
  Description of Artificial Sequence: Synthetic polypeptide
DIQMTQSPSSLSASVGDRVTITCRASQTIASYVNWYQQKPGKAPKLLIYAASNLQSGVPSRFSGSGSGTDFTLTISSLQPEDFATYYCQQSYSVPRLTFGGGTKVDITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5584 - protein, 213 aa, Artificial Sequence
  Description of Artificial Sequence: Synthetic polypeptide
DIQMTQSPSSLSASVGDRVTITCRSSQTISVFLNWYQQKPGKAPKLLIYAASSLHSAVPSRFSGSGSGTDFTLTISSLQPEDSATYYCQESFSSSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5585 - protein, 215 aa, Artificial Sequence
  Description of Artificial Sequence: Synthetic polypeptide
EIVMTQSPATLSVSPGETATLSCRASQSVSSNLAWYQHKPGQAPRLLIHSASTRATGIPARFSGSGSGTEFTLTISSLQSEDFAVYYCQQYNMWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5586 - protein, 219 aa, Artificial Sequence
  Description of Artificial Sequence: Synthetic polypeptide
DIVMTQSPLSLPVTPGAPASISCRSSQSLLRTNGYNYLDWYLQKPGQSPQLLIYLGSIRASGVPDRFSGSGSGTDFTLKISRVEAEDVGVYYCMQSLQTSITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5587 - protein, 214 aa, Artificial Sequence
  Description of Artificial Sequence: Synthetic polypeptide
EIVMTQSPATLSVSPGERATLSCRASQSVGNNLAWYQQRPGQAPRLLIYGASTRATGIPARFSGSGSGTEFTLTISSLQSEDFAVYYCQQYDKWPETFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5588 - protein, 110 aa, Artificial Sequence
  Description of Artificial Sequence: Synthetic polypeptide
QSVVTQTPSVSGAPGQRVTISCTGSSSNIGAGYDVHWYQQLPGTAPKLLIYDNNNRPSGVPDRFSASKSGTSASLAITGLQAEDEADYYCQSYDRNLSGVFGTGTKVTVL

SEQ ID NO: 5589 - protein, 110 aa, Artificial Sequence
  Description of Artificial Sequence: Synthetic polypeptide
QSVLTQPPSMSGAPGQRVTISCTGGSSNIGAGYDVQWYQQLPGAAPKLLIYANDNRPSGVPDRFSGSKSGTSGSLVIAGLRAEDEADYYCQSYDRTLSVVFGGGTKLTVL

SEQ ID NO: 5590 - protein, 110 aa, Artificial Sequence
  Description of Artificial Sequence: Synthetic polypeptide
QSVVTQPPSVSGAPGQRVTISCTGSSSNIGAGYDVHWYQQLPGTAPKLLIYDNNNRPSGVPDRFSASKSGTSASLAITGLQAEDEADYYCQSYDRSLSGVFGTGTKVTVL

SEQ ID NO: 5591 - protein, 110 aa, Artificial Sequence
  Description of Artificial Sequence: Synthetic polypeptide
QSVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGVFGTGTKVTVL

SEQ ID NO: 5592 - protein, 110 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSVVFGGGTKLTVL

SEQ ID NO: 5593 - protein, 213 aa, Artificial Sequence
  Description of Artificial Sequence: Synthetic polypeptide
DIQMTQSPSTLSASVGDRVTITCSLSSRVGYMHWYQQKPGKAPKLLIYDTMYQSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5594 - protein, 107 aa, Artificial Sequence
  Description of Artificial Sequence: Synthetic polypeptide
DIQMTQSPSTLSASVGDRVTITCKASQDINRYLNWYQQKPGKAPKLLIYRANRLVDGVPSRFSGSGSGTEFTLTISSLQPDDFATYYCLQFHEFPYTFGGGTKLEIL

SEQ ID NO: 5595 - protein, 106 aa, Artificial Sequence
  Description of Artificial Sequence: Synthetic polypeptide
DIQMTQSPSTLSASVGDRVTITCKCQLSVGYMHWYQQKPGKAPKLWIYDTSKLASGVPSRFSGSGSGTEFTLTISSLQPDDFATYYCFQGSGYPFTFGGGTKLEIK

SEQ ID NO: 5596 - protein, 108 aa, Artificial Sequence
  Description of Artificial Sequence: Synthetic polypeptide
EIVLTQSPGTLSLSPGERATLSCRASQIVSRNHLAWYQQKPGQAPRLLIFGASSRATGIPVRFSGSGSGTDFTLTINGLAPEDFAVYYCLSSDSSIFTFGPGTKVDFK

SEQ ID NO: 5597 - protein, 109 aa, Artificial Sequence
  Description of Artificial Sequence: Synthetic polypeptide
LTQPHSVSESLGKTVTISCTRAGGRIASNYVQWYQQRPGSSPTTVIYEDNQRPFGVPDRFSGSIDTSSNSASLTISGLKTEDEADYYCQSYDSENPWVFGGGTKLTVLG

SEQ ID NO: 5598 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTSKLASGVPSRFSGSGSGTEFTLTISSLQPDDFATYYCFQGSGYPFTFGGGTKVEIK

SEQ ID NO: 5599 - protein, 106 aa, Artificial Sequence
  Description of Artificial Sequence: Synthetic polypeptide
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKLEIK

SEQ ID NO: 5600 - protein, 106 aa, Artificial Sequence
  Description of Artificial Sequence: Synthetic polypeptide
DIQMTQSPSTLSASVGDRVTITCSLSSRVGYMHWYQQKPGKAPKLLIYDTMYQSSGVPSRFSGSGSGTEFTLTISSLQPDDFATYYCFQGSGYPFTFGGGTKVEIK

SEQ ID NO: 5601 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTFKLSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5602 - protein, 213 aa, Artificial Sequence
  Description of Artificial Sequence: Synthetic polypeptide
DIQMTQSPSTLSASVGDRVTITCLPSSRVGYMHWYQQKPGKAPKLLIYDTMYQSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5603 - protein, 213 aa, Artificial Sequence
  Description of Artificial Sequence: Synthetic polypeptide
DIQMTQSPSTLSASVGDRVTITCSLSSRVGYMHWYQQKPGKAPKLLIYDTFKLSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5604 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTFFLDSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5605 - protein, 213 aa, Artificial Sequence
  Description of Artificial Sequence: Synthetic polypeptide
DIQMTQSPSTLSASVGDRVTITCSPSSRVGYMHWYQQKPGKAPKLLIYDTRYQSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5606 - protein, 213 aa, Artificial Sequence
  Description of Artificial Sequence: Synthetic polypeptide
DIQMTQSPSTLSASVGDRVTITCSPSSRVGYMHWYQQKPGKAPKLLIYDTMRLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5607 - protein, 213 aa, Artificial Sequence
  Description of Artificial Sequence: Synthetic polypeptide
DIQMTQSPSTLSASVGDRVTITCSLSSRVGYMHWYQQKPGKAPKLLIYDTFYLSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5608 - protein, 213 aa, Artificial Sequence
  Description of Artificial Sequence: Synthetic polypeptide
DIQMTQSPSTLSASVGDRVTITCSLSSRVGYMHWYQQKPGKAPKLLIYDTRGLPSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5609 - protein, 95 aa, Artificial Sequence; identical to SEQ ID NO: 4296
  Description of Artificial Sequence: Synthetic polypeptide

SEQ ID NO: 5610 - protein, 95 aa, Artificial Sequence; identical to SEQ ID NO: 4296
  Description of Artificial Sequence: Synthetic polypeptide

SEQ ID NO: 5611 - protein, 111 aa, Artificial Sequence
  Description of Artificial Sequence: Synthetic polypeptide
DIVLTQTPGTLSVSPGERATLSCRASQSVSSNLAWYQQKPGQAPRLLISGASTRATGIPARFSGSGSGTEFTLTISSLQSEDFAVYYCQQYNYWPPWTFGQGTKLEIKRTV

SEQ ID NO: 5612 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTSKLASGVPSRFSGSGSGTEFTLTISSLQPDDFATYYCFQGSFYPFTFGGGTKVEIK

SEQ ID NO: 5613 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQGSGYPFTFGGGTKVEIK

SEQ ID NO: 5614 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQGSFYPFTFGGGTKVEIK

SEQ ID NO: 5615 - protein, 106 aa, Artificial Sequence; identical to SEQ ID NO: 5614
  Description of Artificial Sequence: Synthetic polypeptide

SEQ ID NO: 5616 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQGSYYPFTFGGGTKVEIK

SEQ ID NO: 5617 - protein, 107 aa, Artificial Sequence
  Description of Artificial Sequence: Synthetic polypeptide
DILMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 5618 - protein, 107 aa, Artificial Sequence
  Description of Artificial Sequence: Synthetic polypeptide
DIKMTQSPSSMYVSLGERVTITCKASQDINRYLNWFQQKPGKSPKTLIHRANRLVDGVPSRFSGSGSGQEYSLTISSLEFEDMGIYYCLQFHEFPYTFGGGTKLEIL

SEQ ID NO: 5619 - protein, 214 aa, Artificial Sequence
  Description of Artificial Sequence: Synthetic polypeptide
EIVMTQSPSSLSASIGDRVTITCQASQDISTYLNWYQQKPGQAPRLLIYGASNLETGVPSRFTGSGYGTDFSVTISSLQPEDIATYYCQQYQYLPYTFAPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5620 - protein, 214 aa, Artificial Sequence
  Description of Artificial Sequence: Synthetic polypeptide
DIQMTQSPSSLSASVGDRVTITCRASQNIKNYLNWYQQKPGKVPKLLIYAASTLQSGVPSRFSGSGSGTDFTLTISSLQPEDFATYSCQQSYNNQLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5621 - protein, 216 aa, Artificial Sequence; identical to SEQ ID NO: 5544
  Description of Artificial Sequence: Synthetic polypeptide

SEQ ID NO: 5622 - protein, 215 aa, Artificial Sequence; identical to SEQ ID NO: 5545
  Description of Artificial Sequence: Synthetic polypeptide

SEQ ID NO: 5623 - protein, 217 aa, Artificial Sequence; identical to SEQ ID NO: 5546
  Description of Artificial Sequence: Synthetic polypeptide

SEQ ID NO: 5624 - protein, 213 aa, Artificial Sequence; identical to SEQ ID NO: 5547
  Description of Artificial Sequence: Synthetic polypeptide

SEQ ID NO: 5625 - protein, 215 aa, Artificial Sequence; identical to SEQ ID NO: 5548
  Description of Artificial Sequence: Synthetic polypeptide

SEQ ID NO: 5626 - protein, 219 aa, Artificial Sequence; identical to SEQ ID NO: 5549
  Description of Artificial Sequence: Synthetic polypeptide

SEQ ID NO: 5627 - protein, 215 aa, Artificial Sequence; identical to SEQ ID NO: 5550
  Description of Artificial Sequence: Synthetic polypeptide

SEQ ID NO: 5628 - protein, 214 aa, Artificial Sequence; identical to SEQ ID NO: 5551
  Description of Artificial Sequence: Synthetic polypeptide

SEQ ID NO: 5629 - protein, 219 aa, Artificial Sequence; identical to SEQ ID NO: 5552
  Description of Artificial Sequence: Synthetic polypeptide

SEQ ID NO: 5630 - protein, 215 aa, Artificial Sequence; identical to SEQ ID NO: 5553
  Description of Artificial Sequence: Synthetic polypeptide

SEQ ID NO: 5631 - protein, 214 aa, Artificial Sequence; identical to SEQ ID NO: 5554
  Description of Artificial Sequence: Synthetic polypeptide

SEQ ID NO: 5632 - protein, 220 aa, Artificial Sequence; identical to SEQ ID NO: 5555
  Description of Artificial Sequence: Synthetic polypeptide

SEQ ID NO: 5633 - protein, 215 aa, Artificial Sequence; identical to SEQ ID NO: 5556
  Description of Artificial Sequence: Synthetic polypeptide

SEQ ID NO: 5634 - protein, 215 aa, Artificial Sequence; identical to SEQ ID NO: 5557
  Description of Artificial Sequence: Synthetic polypeptide

SEQ ID NO: 5635 - protein, 219 aa, Artificial Sequence; identical to SEQ ID NO: 5558
  Description of Artificial Sequence: Synthetic polypeptide

SEQ ID NO: 5636 - protein, 213 aa, Artificial Sequence; identical to SEQ ID NO: 5559
  Description of Artificial Sequence: Synthetic polypeptide

SEQ ID NO: 5637 - protein, 215 aa, Artificial Sequence; identical to SEQ ID NO: 5560
  Description of Artificial Sequence: Synthetic polypeptide

SEQ ID NO: 5638 - protein, 216 aa, Artificial Sequence; identical to SEQ ID NO: 5561
  Description of Artificial Sequence: Synthetic polypeptide

SEQ ID NO: 5639 - protein, 214 aa, Artificial Sequence; identical to SEQ ID NO: 5562
  Description of Artificial Sequence: Synthetic polypeptide

SEQ ID NO: 5640 - protein, 220 aa, Artificial Sequence; identical to SEQ ID NO: 5563
  Description of Artificial Sequence: Synthetic polypeptide

SEQ ID NO: 5641 - protein, 214 aa, Artificial Sequence; identical to SEQ ID NO: 5564
  Description of Artificial Sequence: Synthetic polypeptide

SEQ ID NO: 5642 - protein, 214 aa, Artificial Sequence; identical to SEQ ID NO: 5565
  Description of Artificial Sequence: Synthetic polypeptide

SEQ ID NO: 5643 - protein, 214 aa, Artificial Sequence; identical to SEQ ID NO: 5566
  Description of Artificial Sequence: Synthetic polypeptide

SEQ ID NO: 5644 - protein, 214 aa, Artificial Sequence; identical to SEQ ID NO: 5567
  Description of Artificial Sequence: Synthetic polypeptide

SEQ ID NO: 5645 - protein, 214 aa, Artificial Sequence; identical to SEQ ID NO: 5568
  Description of Artificial Sequence: Synthetic polypeptide

SEQ ID NO: 5646 - protein, 214 aa, Artificial Sequence; identical to SEQ ID NO: 5569
  Description of Artificial Sequence: Synthetic polypeptide

SEQ ID NO: 5647 - protein, 220 aa, Artificial Sequence; identical to SEQ ID NO: 5570
  Description of Artificial Sequence: Synthetic polypeptide

SEQ ID NO: 5648 - protein, 215 aa, Artificial Sequence; identical to SEQ ID NO: 5571
  Description of Artificial Sequence: Synthetic polypeptide

SEQ ID NO: 5649 - protein, 214 aa, Artificial Sequence; identical to SEQ ID NO: 5572
  Description of Artificial Sequence: Synthetic polypeptide

SEQ ID NO: 5650 - protein, 220 aa, Artificial Sequence; identical to SEQ ID NO: 5573
  Description of Artificial Sequence: Synthetic polypeptide

SEQ ID NO: 5651 - protein, 219 aa, Artificial Sequence; identical to SEQ ID NO: 5574
  Description of Artificial Sequence: Synthetic polypeptide

SEQ ID NO: 5652 - protein, 214 aa, Artificial Sequence; identical to SEQ ID NO: 5575
  Description of Artificial Sequence: Synthetic polypeptide

SEQ ID NO: 5653 - protein, 214 aa, Artificial Sequence; identical to SEQ ID NO: 5576
  Description of Artificial Sequence: Synthetic polypeptide

SEQ ID NO: 5654 - protein, 215 aa, Artificial Sequence; identical to SEQ ID NO: 5577
  Description of Artificial Sequence: Synthetic polypeptide

SEQ ID NO: 5655 - protein, 213 aa, Artificial Sequence; identical to SEQ ID NO: 5578
  Description of Artificial Sequence: Synthetic polypeptide

SEQ ID NO: 5656 - protein, 215 aa, Artificial Sequence; identical to SEQ ID NO: 5579
  Description of Artificial Sequence: Synthetic polypeptide

SEQ ID NO: 5657 - protein, 214 aa, Artificial Sequence
  Description of Artificial Sequence: Synthetic polypeptide
DIQMTQSPPSLSASVGDRVTTCRASQRIASYLNWYQQKPGRAPKLLIFAASSLQSGVPSRFSGSGSGTDFTLTISSLQPEDYATYYCQQSYSTPIYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5658 - protein, 214 aa, Artificial Sequence; identical to SEQ ID NO: 5581
  Description of Artificial Sequence: Synthetic polypeptide

SEQ ID NO: 5659 - protein, 214 aa, Artificial Sequence; identical to SEQ ID NO: 5582
  Description of Artificial Sequence: Synthetic polypeptide

SEQ ID NO: 5660 - protein, 215 aa, Artificial Sequence; identical to SEQ ID NO: 5583
  Description of Artificial Sequence: Synthetic polypeptide

SEQ ID NO: 5661 - protein, 213 aa, Artificial Sequence; identical to SEQ ID NO: 5584
  Description of Artificial Sequence: Synthetic polypeptide

SEQ ID NO: 5662 - protein, 215 aa, Artificial Sequence; identical to SEQ ID NO: 5585
  Description of Artificial Sequence: Synthetic polypeptide

SEQ ID NO: 5663 - protein, 219 aa, Artificial Sequence; identical to SEQ ID NO: 5586
  Description of Artificial Sequence: Synthetic polypeptide

SEQ ID NO: 5664 - protein, 214 aa, Artificial Sequence; identical to SEQ ID NO: 5587
  Description of Artificial Sequence: Synthetic polypeptide

SEQ ID NO: 5665 - protein, 111 aa, Artificial Sequence
  Description of Artificial Sequence: Synthetic polypeptide
DIVLTQSPASLAVSLGQRATIFCRASQSVDLFGRSYMHWFQQKPGQPPKLLIYAASNPESGIPARFTGSGSGTDFTLNIHPVEEEDAATYYCQQIIEDPWTFGGGTKLEIK

SEQ ID NO: 5666 - protein, 111 aa, Artificial Sequence
  Description of Artificial Sequence: Synthetic polypeptide
DIVLTQSPASLAVSLGQRATIFCRASQSVDLFGKSYMHWFQQKPGQPPKLLIYAASNPESGIPARFTGSGSGTDFTLNIHPVEEEDAATYYCQQIIEDPWTFGGGTKLEIK

SEQ ID NO: 5667 - protein, 111 aa, Artificial Sequence
  Description of Artificial Sequence: Synthetic polypeptide
DIVLTQSPASLAVSLGQRATIFCRASQSVDLFGQSYMHWFQQKPGQPPKLLIYAASNPESGIPARFTGSGSGTDFTLNIHPVEEEDAATYYCQQIIEDPWTFGGGTKLEIK

SEQ ID NO: 5668 - protein, 111 aa, Artificial Sequence
  Description of Artificial Sequence: Synthetic polypeptide
DIVLTQSPASLAVSLGQRATIFCRASQSVDLFGVSYMHWFQQKPGQPPKLLIYAASNPESGIPARFTGSGSGTDFTLNIHPVEEEDAATYYCQQIIEDPWTFGGGTKLEIK

SEQ ID NO: 5669 - protein, 111 aa, Artificial Sequence
  Description of Artificial Sequence: Synthetic polypeptide
DIVLTQSPASLAVSLGQRATIFCRASQSVDHFGKSYVHWFQQKPGQPPKLLIYAASNPESGIPARFTGSGSGTDFTLNIHPVEEEDAATYYCQQIIEDPWTFGGGTKLEIK

SEQ ID NO: 5670 - protein, 111 aa, Artificial Sequence
  Description of Artificial Sequence: Synthetic polypeptide
DIVLTQSPASLAVSLGQRATIFCRASQSVDVFGRSYMHWFQQKPGQPPKLLIYAASNPESGIPARFTGSGSGTDFTLNIHPVEEEDAATYYCQQIIEDPWTFGGGTKLEIK

SEQ ID NO: 5671 - protein, 111 aa, Artificial Sequence
  Description of Artificial Sequence: Synthetic polypeptide
DIVLTQSPASLAVSLGQRATIFCRASQSVDLFGTSYMHWFQQKPGQPPKLLIYAASNPESGIPARFTGSGSGTDFTLNIHPVEEEDAATYYCQQIIEDPWTFGGGTKLEIK

SEQ ID NO: 5672 - protein, 111 aa, Artificial Sequence
  Description of Artificial Sequence: Synthetic polypeptide
DIVLTQSPASLAVSLGQRATIFCRASQSVDYLGRSYMHWFQQKPGQPPKLLIYAASNPESGIPARFTGSGSGTDFTLNIHPVEEEDAATYYCQQIIEDPWTFGGGTKLEIK

SEQ ID NO: 5673 - protein, 111 aa, Artificial Sequence
  Description of Artificial Sequence: Synthetic polypeptide
DIVLTQSPASLAVSLGQRATIFCRASQSVDLFGSSYMHWFQQKPGQPPKLLIYAASNPESGIPARFTGSGSGTDFTLNIHPVEEEDAATYYCQQIIEDPWTFGGGTKLEIK

SEQ ID NO: 5674 - protein, 111 aa, Artificial Sequence
  Description of Artificial Sequence: Synthetic polypeptide
DIVLTQSPASLAVSLGQRATIFCRASQSVDYSGRSYMHWFQQKPGQPPKLLIYAASNPESGIPARFTGSGSGTDFTLNIHPVEEEDAATYYCQQIIEDPWTFGGGTKLEIK

SEQ ID NO: 5675 - protein, 111 aa, Artificial Sequence
  Description of Artificial Sequence: Synthetic polypeptide
DIVLTQSPASLAVSLGQRATIFCRASQSVDFFGKSYMHWFQQKPGQPPKLLIYAASNPESGIPARFTGSGSGTDFTLNIHPVEEEDAATYYCQQIIEDPWTFGGGTKLEIK

SEQ ID NO: 5676 - protein, 111 aa, Artificial Sequence
  Description of Artificial Sequence: Synthetic polypeptide
DIVMTQSPDSLAVSLGERATINCRASDSVDLFGKSYMHWYQQKPGQPPKLLIYAASNPESGVPDRFSGSGSGTDFTLTISSLQAEDVAVYYCQQIIDDPWTFGQGTKVEIK

SEQ ID NO: 5677 - protein, 111 aa, Artificial Sequence
  Description of Artificial Sequence: Synthetic polypeptide
DIVMTQSPDSLAVSLGERATINCRASDSVDLFGRSYMHWYQQKPGQPPKLLIYAASNPESGVPDRFSGSGSGTDFTLTISSLQAEDVAVYYCQQIIDDPWTFGQGTKVEIK

SEQ ID NO: 5678 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHLYWDDDYRYNPSLKSRLTITKDTSKNQVVLTMTNMDPVDTATYYCARLYGFTYGFAYWGQGTLVTVSS

SEQ ID NO: 5679 - protein, 111 aa, Artificial Sequence
  Description of Artificial Sequence: Synthetic polypeptide
DIVMTQSPDSLAVSLGERATINCRASDSVDLFGQSYMHWYQQKPGQPPKLLIYAASNPESGVPDRFSGSGSGTDFTLTISSLQAEDVAVYYCQQIIDDPWTFGQGTKVEIK

SEQ ID NO: 5680 - protein, 120 aa, Artificial Sequence; identical to SEQ ID NO: 5305
  Description of Artificial Sequence: Synthetic polypeptide

SEQ ID NO: 5681 - protein, 111 aa, Artificial Sequence
  Description of Artificial Sequence: Synthetic polypeptide
DIVMTQSPDSLAVSLGERATINCRASDSVDLFGVSYMHWYQQKPGQPPKLLIYAASNPESGVPDRFSGSGSGTDFTLTISSLQAEDVAVYYCQQIIDDPWTFGQGTKVEIK

SEQ ID NO: 5682 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHIYWDDDKRYSPSLKSRLTITKDTSKNQVVLTMTNMDPVDTATYYCARLYGFTYGFAYWGQGTLVTVSS

SEQ ID NO: 5683 - protein, 111 aa, Artificial Sequence
  Description of Artificial Sequence: Synthetic polypeptide
DIVMTQSPDSLAVSLGERATINCRASQSVDFFGTSYMHWYQQKPGQPPKLLIYAASNPESGVPDRFSGSGSGTDFTLTISSLQAEDVAVYYCQQIIDDPWTFGQGTKVEIK

SEQ ID NO: 5684 - protein, 111 aa, Artificial Sequence
  Description of Artificial Sequence: Synthetic polypeptide
DIVMTQSPDSLAVSLGERATINCRASDSVDLFGISYQHWYQQKPGQPPKLLIYAASNPESGVPDRFSGSGSGTDFTLTISSLQAEDVAVYYCQQIIEDPWTFGQGTKVEIK

SEQ ID NO: 5685 - protein, 111 aa, Artificial Sequence
  Description of Artificial Sequence: Synthetic polypeptide
DIVMTQSPDSLAVSLGERATINCRASQSVDLFGQSYMHWYQQKPGQPPKLLIYAASNPESGVPDRFSGSGSGTDFTLTISSLQAEDVAVYYCQQIIDDPWTFGQGTKVEIK

SEQ ID NO: 5686 - protein, 111 aa, Artificial Sequence
  Description of Artificial Sequence: Synthetic polypeptide
DIVMTQSPDSLAVSLGERATINCRASHSVDLFGTSYMHWYQQKPGQPPKLLIYAASNPESGVPDRFSGSGSGTDFTLTISSLQAEDVAVYYCQQIIDDPWTFGQGTKVEIK

SEQ ID NO: 5687 - protein, 120 aa, Artificial Sequence
  Description of Artificial Sequence: Synthetic polypeptide
QITLKESGPTLVKPTQTLTLTCTFSGFSLSTSGMGVSWIRQPPGKALEWLAHLYWDDDKRYSPSLKSRLTITKDTSKNQVVLTMTNMDPVDTATYYCARLYGFTYGFAYWGQGTLVTVSS

SEQ ID NO: 5688 - protein, 111 aa, Artificial Sequence
  Description of Artificial Sequence: Synthetic polypeptide
DIVMTQSPDSLAVSLGERATINCRASDSVDLFGTSYMHWYQQKPGQPPKLLIYAASNPESGVPDRFSGSGSGTDFTLTISSLQAEDVAVYYCQQIIDDPWTFGQGTKVEIK

SEQ ID NO: 5689 - protein, 111 aa, Artificial Sequence
  Description of Artificial Sequence: Synthetic polypeptide
DIVMTQSPDSLAVSLGERATINCRASQSVDLFGTSYMHWYQQKPGQPPKLLIYAASNPESGVPDRFSGSGSGTDFTLTISSLQAEDVAVYYCQQIIDDPWTFGQGTKVEIK

SEQ ID NO: 5690 - protein, 111 aa, Artificial Sequence
  Description of Artificial Sequence: Synthetic polypeptide
DIVMTQSPDSLAVSLGERATINCRASQSVDFFGKSYMHWYQQKPGQPPKLLIYAASNPESGVPDRFSGSGSGTDFTLTISSLQAEDVAVYYCQQIIDDPWTFGQGTKVEIK

SEQ ID NO: 5691 - protein, 111 aa, Artificial Sequence
  Description of Artificial Sequence: Synthetic polypeptide
DIVMTQSPDSLAVSLGERATINCRASDSVDFFGKSYMHWYQQKPGQPPKLLIYAASNPESGVPDRFSGSGSGTDFTLTISSLQAEDVAVYYCQQIIDDPWTFGQGTKVEIK

SEQ ID NO: 5692 - protein, 111 aa, Artificial Sequence
  Description of Artificial Sequence: Synthetic polypeptide
DIVMTQSPDSLAVSLGERATINCRASDSVDLFGRSYMHWYQQKPGQPPKLLIYAASNPESGVPDRFSGSGSGTDFTLTISSLQAEDVAVYYCQQIIEDPWTFGQGTKVEIK

SEQ ID NO: 5693 - protein, 111 aa, Artificial Sequence
  Description of Artificial Sequence: Synthetic polypeptide
DIVMTQSPDSLAVSLGERATINCRASQSVDYFGVSYMHWYQQKPGQPPKLLIYAASNPESGVPDRFSGSGSGTDFTLTISSLQAEDVAVYYCQQIIDDPWTFGQGTKVEIK

SEQ ID NO: 5694 - protein, 111 aa, Artificial Sequence
  Description of Artificial Sequence: Synthetic polypeptide
DIVMTQSPDSLAVSLGERATINCRASDSVDYFGVSYMHWYQQKPGQPPKLLIYAASNPESGVPDRFSGSGSGTDFTLTISSLQAEDVAVYYCQQIIDDPWTFGQGTKVEIK

SEQ ID NO: 5695 - protein, 111 aa, Artificial Sequence
  Description of Artificial Sequence: Synthetic polypeptide
DIVMTQSPDSLAVSLGERATINCRASQSVDYLGKSYMHWYQQKPGQPPKLLIYAASNPESGVPDRFSGSGSGTDFTLTISSLQAEDVAVYYCQQIIDDPWTFGQGTKVEIK

SEQ ID NO: 5696 - protein, 111 aa, Artificial Sequence; identical to SEQ ID NO: 5695
  Description of Artificial Sequence: Synthetic polypeptide

SEQ ID NO: 5697 - protein, 110 aa, Artificial Sequence
  Description of Artificial Sequence: Synthetic polypeptide
DIVMTQSPDSLAVSLGERATINCRASQSVDYFGRSYMHWYQQKPGQPPKLLIYAASNPESGVPDRFSGSGSGTDFTLTISSLQAEDVAVYYCQQIIDDPWTFGQGTKVEI

SEQ ID NO: 5698 - protein, 111 aa, Artificial Sequence
  Description of Artificial Sequence: Synthetic polypeptide
DIVMTQSPDSLAVSLGERATINCRASQSVDYFGTSYMHWYQQKPGQPPKLLIYAASNPESGVPDRFSGSGSGTDFTLTISSLQAEDVAVYYCQQIIDDPWTFGQGTKVEIK

SEQ ID NO: 5699 - protein, 111 aa, Artificial Sequence
  Description of Artificial Sequence: Synthetic polypeptide
DIVMTQSPDSLAVSLGERATINCRASQSVDLLGGSYMHWYQQKPGQPPKLLIYAASNPESGVPDRFSGSGSGTDFTLTISSLQAEDVAVYYCQQIIEDPWTFGQGTKVEIK

SEQ ID NO: 5700 - protein, 15 aa, Artificial Sequence
  Description of Artificial Sequence: Synthetic peptide
RASQSVDLLGGSYMH

SEQ ID NO: 5701 - protein, 111 aa, Artificial Sequence
  Description of Artificial Sequence: Synthetic polypeptide
DIVMTQSPDSLAVSLGERATINCRASQSVDYNGISYMHWYQQKPGQPPKLLIYAASNPESGVPDRFSGSGSGTDFTLTISSLQAEDVAVYYCQQIIDDPWTFGQGTKVEIK

SEQ ID NO: 5702 - protein, 9 aa, Artificial Sequence
  Description of Artificial Sequence: Synthetic peptide
QQIIDDPWT

SEQ ID NO: 5703 - protein, 111 aa, Artificial Sequence
  Description of Artificial Sequence: Synthetic polypeptide
DIVMTQSPDSLAVSLGERATINCRASDSVDYFGQSYMHWYQQKPGQPPKLLIYAASNPESGVPDRFSGSGSGTDFTLTISSLQAEDVAVYYCQQIIDDPWTFGQGTKVEIK

SEQ ID NO: 5704 - protein, 111 aa, Artificial Sequence
  Description of Artificial Sequence: Synthetic polypeptide
DIVMTQSPDSLAVSLGERATINCRASDSVDLFGQSYMHWYQQKPGQPPKLLIYAASNPESGVPDRFSGSGSGTDFTLTISSLQAEDVAVYYCQQIIADPWTFGQGTKVEIK

SEQ ID NO: 5705 - protein, 9 aa, Artificial Sequence
  Description of Artificial Sequence: Synthetic peptide
QQIIADPWT

SEQ ID NO: 5706 - protein, 111 aa, Artificial Sequence
  Description of Artificial Sequence: Synthetic polypeptide
DIVMTQSPDSLAVSLGERATINCRASDSVDLFGVSYMHWYQQKPGQPPKLLIYAASNPESGVPDRFSGSGSGTDFTLTISSLQAEDVAVYYCQQIIEDPWTFGQGTKVEIK

SEQ ID NO: 5707 - protein, 111 aa, Artificial Sequence
  Description of Artificial Sequence: Synthetic polypeptide
DIVMTQSPDSLAVSLGERATINCRASDSVDYFGRSYMHWYQQKPGQPPKLLIYAASNPESGVPDRFSGSGSGTDFTLTISSLQAEDVAVYYCQQIIDDPWTFGQGTKVEIK

SEQ ID NO: 5708 - protein, 111 aa, Artificial Sequence
  Description of Artificial Sequence: Synthetic polypeptide
QSVLTQPPSVSAAPGQKVTISCTGSSSNLGAGYDVHWYRQLPGTAPKLLIYDNNNRPSGVPDRFSGSKSGPSASLAISGLQAEDEADYYCQSYDSSLNGYVFGTGTQLTVL

SEQ ID NO: 5709 - protein, 128 aa, Artificial Sequence
  Description of Artificial Sequence: Synthetic polypeptide
MGWSCIILFLVATATGVHSELTQPPSVSGAPGQRVTISCTGSSSNIGAGYDVHWYQQLPGTAPKLLIYGNSNRPSGVPDRFSGSKSGTSASLAITGLQAEDEADYYCQSYDSSLNGYVFGTGTQLTVL

SEQ ID NO: 5710 - protein, 130 aa, Artificial Sequence
  Description of Artificial Sequence: Synthetic polypeptide
MGWSCIILFLVATATGVHSQSVLTQPPSVSGAPGQRVTISCTGSSSNIGAGYDVHWYQQLPGTAPKLLIYGNSNRPSGVPDRFSGSKSGTSASLAITGLQAEDEADYYCQSYDSSLNGYVFGTGTQLTVL

SEQ ID NO: 5711 - protein, 124 aa, Artificial Sequence
  Description of Artificial Sequence: Synthetic polypeptide
MGWSCIILFLVATATGVHSELTQSPSSLSASVGDRVTITCRATQSVSNFLNWYQQKPGEAPTLLIYDASTSQSGVPSRFSGSGSGMDFSLTISSLQPEDLAMYYCQASINTPLFGGGTRIDMRR

SEQ ID NO: 5712 - protein, 101 aa, Artificial Sequence
  Description of Artificial Sequence: Synthetic polypeptide
MRVPAQLLGLLLLWLRGARCDIQMNFLNWYQQKPGEAPTLLIYDASTSQSGVPSRFSGSGSGMDFSLTISSLQPEDLAMYYCQASINTPLFGGGTRIDMRR

SEQ ID NO: 5713 - protein, 106 aa, Artificial Sequence; identical to SEQ ID NO: 4628
  Description of Artificial Sequence: Synthetic polypeptide

SEQ ID NO: 5714 - protein, 106 aa, Artificial Sequence
  Description of Artificial Sequence: Synthetic polypeptide
TVAAPSVFIFPPSDEQLKSGTASVVCLLNNFYPREAKVQWKVDNALQSGNSQESVTEQDSKDSTYSLSSTLTLSKADYEKHKVYACEVTHQGLSLPVTKSFNRGEC

SEQ ID NO: 5715 - protein, 111 aa, Artificial Sequence
  Description of Artificial Sequence: Synthetic polypeptide
DIQLTQSPLSLPVTLGDQASISCRSSQTLVHTDGNTYLEWFLQKPGQSPKLLIYRVSNRFSGVPDRFSGSGSGTDFTLKISRVEAEDLGVYFCFQGSHLPRTFGGGTKLEI

SEQ ID NO: 5716 - protein, 111 aa, Artificial Sequence
  Description of Artificial Sequence: Synthetic polypeptide
DIQLTQSPSSLSASVGDRVTITCRSSQTLVHTDGNTYLEWYQQKPGAPKLLIYRVSNRFSGVPSRFSGSGSGTDFTFTISSLQPEDIATYYCQSHLPRTFGQGTKVEIKDE

SEQ ID NO: 5717 - protein, 213 aa, Artificial Sequence; identical to SEQ ID NO: 5607
  Description of Artificial Sequence: Synthetic polypeptide

SEQ ID NO: 5718 - protein, 208 aa, Artificial Sequence
  Description of Artificial Sequence: Synthetic polypeptide
DIQMTQSPSTLSASVGDRVTITCSLSSRVGYMHWYQQKPGKAPKLLIYDTRGLPSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSF

SEQ ID NO: 5719 - protein, 213 aa, Artificial Sequence; identical to SEQ ID NO: 5606
  Description of Artificial Sequence: Synthetic polypeptide

SEQ ID NO: 5720 - protein, 213 aa, Artificial Sequence; identical to SEQ ID NO: 5603
  Description of Artificial Sequence: Synthetic polypeptide

SEQ ID NO: 5721 - protein, 213 aa, Artificial Sequence; identical to SEQ ID NO: 5601
  Description of Artificial Sequence: Synthetic polypeptide

SEQ ID NO: 5722 - protein, 213 aa, Artificial Sequence; identical to SEQ ID NO: 5593
  Description of Artificial Sequence: Synthetic polypeptide

SEQ ID NO: 5723 - protein, 213 aa, Artificial Sequence; identical to SEQ ID NO: 5602
  Description of Artificial Sequence: Synthetic polypeptide

SEQ ID NO: 5724 - protein, 213 aa, Artificial Sequence; identical to SEQ ID NO: 5604
  Description of Artificial Sequence: Synthetic polypeptide

SEQ ID NO: 5725 - protein, 213 aa, Artificial Sequence; identical to SEQ ID NO: 5605
  Description of Artificial Sequence: Synthetic polypeptide

SEQ ID NO: 5726 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTSKLASGVPSRFSGSGSGTEFTLTISSLQPDDFATYYCFQGSGYPFTFGGGTKLEIK

SEQ ID NO: 5727 - protein, 213 aa, Artificial Sequence
  Description of Artificial Sequence: Synthetic polypeptide
DIQMTQSPSTLSASVGDRVTITCSASSSVGYMHWYQQKPGKAPKLLIYDTYKQTSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5728 - protein, 101 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTP

SEQ ID NO: 5729 - protein, 111 aa, Artificial Sequence
  Description of Artificial Sequence: Synthetic polypeptide
DIVLTQSPASLAVSLGQRATIFCRASQSVDYNGISYMHWFQQKPGQPPKLLIYAASNPESGIPARFTGSGSGTDFTLNIHPVEEEDAATYYCQQIIEDPWTFGGGTKLEIK

SEQ ID NO: 5730 - protein, 108 aa, Artificial Sequence
  Description of Artificial Sequence: Synthetic polypeptide
DIKVTQSPSSMYASLGERVTITCKASQDINNYLNWFQQKPGKSPKTLIYRANRLLDGVPSRFSGSGSGQDYSLTISSLEYEDMGIYYCLQFDEFPYTFGGGTKLEIKR

SEQ ID NO: 5731 - protein, 106 aa, Artificial Sequence
  Description of Artificial Sequence: Synthetic polypeptide
DIQMTQSPSTLSASVGDRVTITCSLSSRVGYMHWYQQKPGKAPKLLIYDTFYLSSGVPSRFSGSGSGTEFTLTISSLQPDDFATYYCFQGSGYPFTFGGGTKVEIK

SEQ ID NO: 5732 - protein, 106 aa, Artificial Sequence
  Description of Artificial Sequence: Synthetic polypeptide
DIQMTQSPSTLSASVGDRVTITCSLSSRVGYMHWYQQKPGKAPKLLIYDTRGLPSGVPSRFSGSGSGTEFTLTISSLQPDDFATYYCFQGSGYPFTFGGGTKVEIK

SEQ ID NO: 5733 - protein, 106 aa, Artificial Sequence
  Description of Artificial Sequence: Synthetic polypeptide
DIQMTQSPSTLSASVGDRVTITCSPSSRVGYMHWYQQKPGKAPKLLIYDTMRLASGVPSRFSGSGSGTEFTLTISSLQPDDFATYYCFQGSGYPFTFGGGTKVEIK

SEQ ID NO: 5734 - protein, 106 aa, Artificial Sequence
  Description of Artificial Sequence: Synthetic polypeptide
DIQMTQSPSTLSASVGDRVTITCSLSSRVGYMHWYQQKPGKAPKLLIYDTFKLSSGVPSRFSGSGSGTEFTLTISSLQPDDFATYYCFQGSGYPFTFGGGTKVEIK

SEQ ID NO: 5735 - protein, 106 aa, Artificial Sequence
  Description of Artificial Sequence: Synthetic polypeptide
DIQMTQSPSTLSASVGDRVTITCSASSRVGYMHWYQQKPGKAPKLLIYDTFKLSSGVPSRFSGSGSGTEFTLTISSLQPDDFATYYCFQGSGYPFTFGGGTKVEIK

SEQ ID NO: 5736 - protein, 106 aa, Artificial Sequence; identical to SEQ ID NO: 5600
  Description of Artificial Sequence: Synthetic polypeptide

SEQ ID NO: 5737 - protein, 106 aa, Artificial Sequence
  Description of Artificial Sequence: Synthetic polypeptide
DIQMTQSPSTLSASVGDRVTITCLPSSRVGYMHWYQQKPGKAPKLLIYDTMYQASGVPSRFSGSGSGTEFTLTISSLQPDDFATYYCFQFSGYPFTFGGGTKLEIK

SEQ ID NO: 5738 - protein, 106 aa, Artificial Sequence
  Description of Artificial Sequence: Synthetic polypeptide
DIQMTQSPSTLSASVGDRVTITCSASSRVGYMHWYQQKPGKAPKLLIYDTFFLDSGVPSRFSGSGSGTEFTLTISSLQPDDFATYYCFQGSGYPFTFGGGTKLEIK

SEQ ID NO: 5739 - protein, 106 aa, Artificial Sequence
  Description of Artificial Sequence: Synthetic polypeptide
DIQMTQSPSTLSASVGDRVTITCSASSRVGYMHWYQQKPGKAPKLLIYDTRYQSSGVPSRFSGSGSGTEFTLTISSLQPDDFATYYCFQGSGYPFTFGGGTKLEIK

SEQ ID NO: 5740 - protein, 450 aa, Artificial Sequence; identical to SEQ ID NO: 5490
  Description of Artificial Sequence: Synthetic polypeptide

SEQ ID NO: 5741 - protein, 107 aa, Artificial Sequence
  Description of Artificial Sequence: Synthetic polypeptide
DIQMTQSPSSLSASVGDRVTITCRTSQSISTYLNWYQQKPGKAPKFLIYAASTLQSGVPSRFSGSGSRTDFTLTISSLQPEDFATYYCQQSVSVPYTFGQGTKLEIK

SEQ ID NO: 5742 - protein, 107 aa, Artificial Sequence
  Description of Artificial Sequence: Synthetic polypeptide
DIQMTQSPSSLSASVGDRVTITCRASQGIRNDLGWYQQKPGKAPKRLIYGASSLQSGVPSRFSGSGSGTEFTLTISSLQPEDFATYSCLQHNSYPWTFGQGTKVEIK

SEQ ID NO: 5743 - protein, 107 aa, Artificial Sequence
  Description of Artificial Sequence: Synthetic polypeptide
AIQMTQSPSSLSASVGDRVTITCRASQAIRNDLGWYQQKPGKAPKLLIYASSSLQSGVPSRFSGSGSGTDFTLTISSLQPEDFATYYCLADYKYTWTFGQGTKVEIK

SEQ ID NO: 5744 - protein, 107 aa, Artificial Sequence; identical to SEQ ID NO: 5743
  Description of Artificial Sequence: Synthetic polypeptide

SEQ ID NO: 5745 - protein, 107 aa, Artificial Sequence
  Description of Artificial Sequence: Synthetic polypeptide
DIQMTQSPSSVSASVGDRVTITCRASQGISSWLAWYQQKPGKAPKLLIYAASSLQSGVPSRFSGSGSGTDFTLTISSLQPEDFATYYCQQTNSFPLTFGGGTKVDIK

SEQ ID NO: 5746 - protein, 107 aa, Artificial Sequence
  Description of Artificial Sequence: Synthetic polypeptide
EIVLTQSPATLSLSPGERATLSCRASQSVTSYLAWYQQKPGQAPRLLIYDVSKRATGIPARFSGSGSGTDFTLTISSLEPEDFATYYCQQRSNWPPTFGQGTRLEIK

SEQ ID NO: 5747 - protein, 107 aa, Artificial Sequence
  Description of Artificial Sequence: Synthetic polypeptide
DIQMTQSPSSLSASVGDRVTITCRASQNIDIYLNWYQERPGKAPNLLIYAASSLQSGVPSRFSGSGSGTDFTLTISSLQPEDFATYYCQQSYNTPFTFGGGTKVEIK

SEQ ID NO: 5748 - protein, 107 aa, Artificial Sequence
  Description of Artificial Sequence: Synthetic polypeptide
EIVMTQSPATLSLSPGERATLSCRPSQSVINNLAWYQQKPGQAPRLLIFGASSRATGIPARFSGSGSGTEFTLTISSLQSEDFALYYCQQYNNWPLTFGGGTKVEIK

SEQ ID NO: 5749 - protein, 107 aa, Artificial Sequence
  Description of Artificial Sequence: Synthetic polypeptide
EIVMTQSPATLSVSPGERATLSCRASQTILSNLAWYLQKPGQAPRLLIYGASTRATGLPARFSGSGSGTEFTLTISSLQSEDFAVYYCQQYNNWPLTFGGGTKVEIK

SEQ ID NO: 5750 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFRGSGSDKDFTLKISRVGAEDVGVYYCMQALQTITFGQGTRLEIK

SEQ ID NO: 5751 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFRGSGSGKDFTLKISRVEAEDVGLYYCMQALQTITFGQGTRLEIK

SEQ ID NO: 5752 - protein, 107 aa, Artificial Sequence
  Description of Artificial Sequence: Synthetic polypeptide
DIQMTQSPSSLSASVGDRVTITCRASQDIGNYLAWFQQKPGKAPESLIYAASILQSGVPSKFSGSGSGTDFTLTISSLQPEDFATYYCQQYNTFPWTFGQGTKVEIK

SEQ ID NO: 5753 - protein, 107 aa, Artificial Sequence
  Description of Artificial Sequence: Synthetic polypeptide
EIVLTQSPATLSLSPGERGTLSCRASQSINNYLAWYQQKPGQAPRLLIFDASNRATGIPARFSGSGSGTDFTLTISRIEPEDFAVYYCQQRTNWPLTFGGGTKVEIK

SEQ ID NO: 5754 - protein, 113 aa, Artificial Sequence
  Description of Artificial Sequence: Synthetic polypeptide
DIVMTQSPDSLAVSLGERATINCKSSQNLLYTSSNKNSLAWYQQKPGQPPELLIYWASTRESGVPDRFSGSGSGTDFILTISSLQAEDVAVYYCQQYYSSPWTFGQGTKVEIK

SEQ ID NO: 5755 - protein, 107 aa, Artificial Sequence
  Description of Artificial Sequence: Synthetic polypeptide
DIQMTQSPSSVSASVGDRVTITCRASQGISIWLAWYQQKPGKAPKLLISAASTLQSGVPSRFSGSGSGTDFTLTISSLQPEDFATYYCQQANSFPLTFGQGTKVEIK

SEQ ID NO: 5756 - protein, 112 aa, Artificial Sequence
  Description of Artificial Sequence: Synthetic polypeptide
DIVMTQSPLSLSVTPGEPASISCRSSQNLLNRNGFNYLDWYLQKPGQSPQLLIYLGSNRASGVPDRFSGSGSGTDFTLKISRVEVEDVGVYYCMQAIQTPYTFGQGTKLEIK

SEQ ID NO: 5757 - protein, 107 aa, Artificial Sequence; identical to SEQ ID NO: 5749
  Description of Artificial Sequence: Synthetic polypeptide

SEQ ID NO: 5758 - protein, 107 aa, Artificial Sequence; identical to SEQ ID NO: 5749
  Description of Artificial Sequence: Synthetic polypeptide

SEQ ID NO: 5759 - protein, 107 aa, Artificial Sequence
  Description of Artificial Sequence: Synthetic polypeptide
DIQMTQSPSSLSASVGDRVTITCRASQDIRNDLGWYQQKPGKAPKCLIYGASSLQSGVPSRFSGSGSGTEFTLTISSLQPEDFATYYCLQHKNYMYTFGQGTKLEIK

SEQ ID NO: 5760 - protein, 112 aa, Artificial Sequence
  Description of Artificial Sequence: Synthetic polypeptide
DIVMTQTPLSSPVILGQPASISCRSSQSLVYSDGNTYLSWLQQRPGQPPRLLIYKISNRFSGVPDRFSGSGTGTDFTLKISRVEAEDVGIYYCMQTTQFPLTFGGGTKVEIK

SEQ ID NO: 5761 - protein, 107 aa, Artificial Sequence
  Description of Artificial Sequence: Synthetic polypeptide
DIQMTQSPSSLSASVGDRVTITCRASQDIRNDLGWYHQKPGKAPKCLIYGASSLQSGVPSRFSGSGSGTEFTLTISSLQPEDFATYYCLQHKNYMYTFGQGTKLEIK

SEQ ID NO: 5762 - protein, 107 aa, Artificial Sequence
  Description of Artificial Sequence: Synthetic polypeptide
DIQMTQSPSSLSASVGDRLTITCRASQTISTYLNWFQQKVGNAPKLLIYSTSSLQSGVPARFSGSGSGTDFTLTISSLQPEDFATYYCQQSYSSPPTFGQGTKVEIK

SEQ ID NO: 5763 - protein, 112 aa, Artificial Sequence
  Description of Artificial Sequence: Synthetic polypeptide
QSVLTQPPSVSAAPGQKVTISCTGSSSNLGAGYDVHWYRQLPGTAPKLLIYDNNNRPSGVPDRFSGSKSGPSASLAISGLQAEDEADYYCQSYDSSLNGYVFGTGTQLTVLG

SEQ ID NO: 5764 - protein, 106 aa, Artificial Sequence
  Description of Artificial Sequence: Synthetic polypeptide
DIQLTQSPAIMSASPGEKVTMTCSASSSVGYMHWYQQKSSTSPKLWIYDTSKLASGVPGRFSGSGSGNSYSLTISSIQAEDVATYYCFQGSGYPFTFGGGTKLEIK

SEQ ID NO: 5765 - protein, 108 aa, Artificial Sequence
  Description of Artificial Sequence: Synthetic polypeptide
DIQMTQSPSSLSASVGDRVTITCKASQDINNYLNWYQQKPGKAPKLLTYRANRLLDGVPSRFSGSGSGTDFTFTISSLQPEDIATYYCLQFDEFPYTFGQGTKLEIKR

SEQ ID NO: 5766 - protein, 108 aa, Artificial Sequence
  Description of Artificial Sequence: Synthetic polypeptide
ETTLTQSPAFMSATPGDKVNISCKASQDINNYLNWYQQKPGEAAIFIIQRANRLLDGIPPRFSGSGYGTDFTLTINNIESEDAAYYFCLQFDEFPYTFGQGTKLEIKR

SEQ ID NO: 5767 - protein, 108 aa, Artificial Sequence
  Description of Artificial Sequence: Synthetic polypeptide
DIQMTQSPSSLSASVGDRVTITCKASQDINNYLNWFQQKPGKAPKSLRYRANRLLDGVPSRFSGSGSGTDFTLTISSLQPEDFATYYCLQFDEFPYTFGQGTKLEIKR

SEQ ID NO: 5768 - protein, 108 aa, Artificial Sequence
  Description of Artificial Sequence: Synthetic polypeptide
VIWMTQSPSLLSASTGDRVTISCKASQDINNYLNWYQQKPGKAPELLIYRANRLLDGVPSRFSGSGSGTDFTLTISYLQSEDFATYYCLQFDEFPYTFGQGTKLEIKR

SEQ ID NO: 5769 - protein, 108 aa, Artificial Sequence
  Description of Artificial Sequence: Synthetic polypeptide
NIQMTQSPSAMSASVGDRVTITCKASQDINNYLNWFQQKPGKVPKHLIYRANRLLDGVPSRFSGSGSGTEFTLTISSLQPEDFATYYCLQFDEFPYTFGQGTKLEIKR

SEQ ID NO: 5770 - protein, 108 aa, Artificial Sequence
  Description of Artificial Sequence: Synthetic polypeptide
DIQLTQSPSFLSASVGDRVTITCKASQDINNYLNWYQQKPGKAPKLLIYRANRLLDGVPSRFSGSGSGTEFTLTISSLQPEDFATYYCLQFDEFPYTFGQGTKLEIKR

SEQ ID NO: 5771 - protein, 112 aa, Artificial Sequence
  Description of Artificial Sequence: Synthetic polypeptide
SVVTQEPSVSGSLGQRVSITCSGSSSNIGRWGVNWYQQVPGSGLRTIIYYESSRPSGVPDRFSGSKSGNTATLTISSLQAEDEADYFCATGDYNIAVFGSGTTLIVMGQPKS

SEQ ID NO: 5772 - protein, 116 aa, Artificial Sequence
  Description of Artificial Sequence: Synthetic polypeptide
SVVTQQPSVSGSLGQRVSITCSGSSDNIGIFAVGWYQQVPGSGLRTIIYGNTKRPSGVPDRFSGSKSGNTATLTINSLQAEDEADYFCVCGESKSATPVFGGGTTLTVLSQPKSPP

SEQ ID NO: 5773 - protein, 107 aa, Artificial Sequence
  Description of Artificial Sequence: Synthetic polypeptide
DIQMTQSPSSLSASVGDRVTITCRAGQRIASYLNWYQHKPGKAPKLLIYAGSNLHRGVPSRFSGGGSGTDFTLTINSLQPEDFATYYCQQAYSTPWTFGPGTKVEIK

SEQ ID NO: 5774 - protein, 106 aa, Artificial Sequence
  Description of Artificial Sequence: Synthetic polypeptide
DIQMTQSPSSLSASVGDRVTITCRASQSIASYVNWYQQKPGKAPKVLIFASANLVSGVPSRFSGSGSGTVFTLTISNLQPEDFATYFCQQSYTNFSFGQGTKLEIK

SEQ ID NO: 5775 - protein, 107 aa, Artificial Sequence
  Description of Artificial Sequence: Synthetic polypeptide
DIQMTQSPSSLSASVGDRVTITCRASQGINNYLAWFQQKPGKAPKSLIYAASTLPSGVPSRFSGSGSGTDFTLTISSLQPEDSATYFCQHYIRYPHTFGQGTKLEIK

SEQ ID NO: 5776 - protein, 108 aa, Artificial Sequence
  Description of Artificial Sequence: Synthetic polypeptide
DIQLTQSPSFLSASVGDRVTITCRASQGIRSYLAWYQQKPGKAPKLLIYAASTLQSGVPSRFSGGGSGTEFTLTISSLQPEDSATYYCQQLNTSPPYTFGQGTKLEIK

SEQ ID NO: 5777 - protein, 113 aa, Artificial Sequence
  Description of Artificial Sequence: Synthetic polypeptide
DIVMTQSPDSLAVSLGERATINCKSSQSVLYSSNNKNYLAWFQQKPGQPPRLLINWASTREFGVPDRFSGSGSGTDFTLTISSLQAEDVAIYYCHQYYSIPLTFGGGTKVEIK

SEQ ID NO: 5778 - protein, 109 aa, Artificial Sequence
  Description of Artificial Sequence: Synthetic polypeptide
EIVLTQSPGTLSLSPGERATLSCRASQNINGNYLAWYQQKPGLAPRLLIYEASSRATGIPDRFSGSGSGTDFTLTISSLEPEDFGVYYCQQYGTSPFFTFGPGTKVDIK

SEQ ID NO: 5779 - protein, 107 aa, Artificial Sequence
  Description of Artificial Sequence: Synthetic polypeptide
DIQMTQSPSSLSASVGDRVTITCRASQGMSNYLNWYQQKPGKAPELLIYAASTLQSGVPSRFSGSGSGTDFTLTINSLQPEDFATYFCQQSFSTPLTFGGGTKVEIK

SEQ ID NO: 5780 - protein, 108 aa, Artificial Sequence
  Description of Artificial Sequence: Synthetic polypeptide
DIQMTQSPSSLSASVGDRVTITCRASQSIDNYLNWYQQKPGKAPKLLIYAASSLQSGVPSRFSGSGSGTDFTLTVSSLHPEDFATYYCQQSYSTLTWTFGQGTKVEIK

SEQ ID NO: 5781 - protein, 109 aa, Artificial Sequence
  Description of Artificial Sequence: Synthetic polypeptide
EIVLTQSPGTLSLSPGERATLSCRASQSITNNYLAWYQQKPGQAPRLLIYDSFSRATGIPERFSGSGSGTDFTLTISRLEPEDFAVYYCQHYVRSPLTFGPGTKVEIKR

SEQ ID NO: 5782 - protein, 107 aa, Artificial Sequence
  Description of Artificial Sequence: Synthetic polypeptide
EIVMTQSPATLSVSPGERATLSCRASQSVNSNLAWYQHKPGQAPRLLIYGASTRATGIPARFSGSGSGTDFTLTISSLQSEDFAVYYCQQYNNWPLFGPGTKVDLKR

SEQ ID NO: 5783 - protein, 109 aa, Artificial Sequence
  Description of Artificial Sequence: Synthetic polypeptide
EIVVTQSPVTLSVSPGESATLSCRSARSVGSRLAWYQQKPGQPPRLLIFAASTRATGIPARFSGSGSGTDFTLIISGLQSEDYAVYYCQQYKEWPLFTFGPGTTVDSKR

SEQ ID NO: 5784 - protein, 106 aa, Artificial Sequence
  Description of Artificial Sequence: Synthetic polypeptide
QIVLTQSPATLSLSPGERATLSCKASQSVSNHLAWYQQKPGQAPRLLIYETSNRATGIPPRFSGSGSGTDFTLTISSLEPEDFAVYYCQQRNNWYTFGQGTKLEIK

SEQ ID NO: 5785 - protein, 108 aa, Artificial Sequence
  Description of Artificial Sequence: Synthetic polypeptide
SFELTQPPSVSVSPGQTARITCSGDALPKQYVYWYQQKPGQAPVLVIYKTTERPSGIPERFSDSSSGTTVTLTISAAQAEDEADYYCQSVDSSGTYVFGIGTKVTVLG

SEQ ID NO: 5786 - protein, 113 aa, Artificial Sequence
  Description of Artificial Sequence: Synthetic polypeptide
QSALTQPASVSGSPGQSITISCTGSSSDVGGYSHVSWYQQHPGKVPKLIISEVSNRPSGISNRFSGSKSANTASLTISGLQPEDEADYYCGSYASTNILHYVFGTGTKVTVLS

SEQ ID NO: 5787 - protein, 114 aa, Artificial Sequence
  Description of Artificial Sequence: Synthetic polypeptide
SYELTQPPSVSVSPGQTGRITCTGSEASGDALASRYAYWYQHKSGQAPVVLIYKDTERPSGISERFSGSSSGTTVTLIISGVLAEDEADYYCKTSVRNGTSWVFGTGTMLTVLR

SEQ ID NO: 5788 - protein, 108 aa, Artificial Sequence
  Description of Artificial Sequence: Synthetic polypeptide
DTPMTQSPSSVSASVGDRVTISCRASQGISNSLAWYQQKLGKAPQLLIYAASSLQSGVPSRFSGSGSGTDFTLTISSLQPEDFATYYCQQTNTFPFTFGPGTKVEVRR

SEQ ID NO: 5789 - protein, 111 aa, Artificial Sequence
  Description of Artificial Sequence: Synthetic polypeptide
QSALTQPPSASGSPGQSVTISCTGTSSDVGGYNYVSWYQQHPGKAPKLMIYEVNKRPSGVPDRFSGSKSGNTASLTVSGLQAEDEAEYYCSSYAGSMNWVFGGGTKLTVLG

SEQ ID NO: 5790 - protein, 114 aa, Artificial Sequence
  Description of Artificial Sequence: Synthetic polypeptide
DIVMTQSPDSLAVSLGERATINCKSSQSVLYSSNNKTYLAWYQQKPRQPPELLIYWASTRESGVPDRFSGSGSGTNFTLTISSLQAEDVAVYYCQQYYTTPYTFGQGTKLEIKR

SEQ ID NO: 5791 - protein, 109 aa, Artificial Sequence
  Description of Artificial Sequence: Synthetic polypeptide
EIVVTQSPVTLSVSPGESAALSCRASRSVGSRLAWYQQKPGQPPRLLIFAASTRATGIPARFSGSGSGTDFTLIISGLQSEDYAVYYCQQYKEWPLFTFGPGTTVDSKR

SEQ ID NO: 5792 - protein, 110 aa, Artificial Sequence
  Description of Artificial Sequence: Synthetic polypeptide
EIVLTQSPATLSLSPGERATLSCRASQSVSSYLAWYQQKPGQAPRLLISDASNRATGIPPRFSGSGSGTDFTLTISSLEPEDFAVYYCQQRSNWPPRFTFGPGTIVDIRR

SEQ ID NO: 5793 - protein, 107 aa, Artificial Sequence
  Description of Artificial Sequence: Synthetic polypeptide
EIVMTQSPATLSVSPGERALSCRASQSVRSNLVWYQQKPGQAPRLLIFGASTRATGIPARFSGSGSGTEFTLTISSLQSEDFALYFCQQNNNWPPTFGQGTRLEIKR

SEQ ID NO: 5794 - protein, 113 aa, Artificial Sequence
  Description of Artificial Sequence: Synthetic polypeptide
DIVMTQTPLSLSVTPGQPASISCRSSQTIVHTNGNTYLEWYLQKPGQSPQLLIYKVSNRFSGVPDRFSGSGSGTDFTLKISRVEAEDVGVYYCFQGSHVPFTFGSGTKLEIKR

SEQ ID NO: 5795 - protein, 115 aa, Artificial Sequence
  Description of Artificial Sequence: Synthetic polypeptide
QPVLTQSPSASASLGASVKLTCTLSSGHRNYAIAWHQQRPEKGPRYLMKIYTNGSHYPGDGTPDRFSGSSSGAERYLTISSLQSEDEADYYCQTWGAGIWVFGGGTKLTVLGQPK

SEQ ID NO: 5796 - protein, 116 aa, Artificial Sequence
  Description of Artificial Sequence: Synthetic polypeptide
DIVMTQSPDSLAVSLGERATFSCKSSQSVLYDSNNKNYLAWYQQRPGQPPKLLIYWASTRESGVPDRFSGSGSGTDFTLTISSLQPEDVAVYYCQQYYDPLITFGQGTRLEIKRTV

SEQ ID NO: 5797 - protein, 110 aa, Artificial Sequence
  Description of Artificial Sequence: Synthetic polypeptide
SYELTQPPSVSVSPGQTARITCSADAFSDQYAYWYQQKPGQAPVLVIYKDTERPSGIPERISGSSSGTTATLSISGVQAEDEADYYCQSTDTSGPLFGGGTKLTLLGQPK

SEQ ID NO: 5798 - protein, 110 aa, Artificial Sequence
  Description of Artificial Sequence: Synthetic polypeptide
DIQMTQSPSTLSASVGDRVTITCRASQGIGSWLAWYQQKPGKAPKLLIYNASGLESGVPSGFSGSGSGTEFTLTISSLQPDDSATYYCQQYNSHTWTFGQGTKVEFKRTV

SEQ ID NO: 5799 - protein, 110 aa, Artificial Sequence
  Description of Artificial Sequence: Synthetic polypeptide
AIQMTQSPSSLSASVGDRVTISCRASQSIDNYLNWYQQKPGKAPKLLLFLASTLQSGVPSRFTGSGSGTDFTLTISSLQPEDFATYYCQQSHSSPYSFGQGTKLEIKRTV

SEQ ID NO: 5800 - protein, 116 aa, Artificial Sequence
  Description of Artificial Sequence: Synthetic polypeptide
DIVMTQSPDSLAVSLGERATINCKSSQSLLHSSNNKIYLAWYQQKPGQPPKLLLYWASTRESGVPDRFTGSGSGTDFTLTINSLQAEDVAVYYCQQYYTTHPTFGQGTRLEIKRTV

SEQ ID NO: 5801 - protein, 111 aa, Artificial Sequence
  Description of Artificial Sequence: Synthetic polypeptide
KIVLTQSPGTLSLSPGERATLSCRASQSVSASNLAWYQQKPGQAPRLLIYGIPDRFSGSGSGTDFTLSISRLEPEDFAVYYCGASRTATQQYGSSPLTFGGGTKVEIKRTV

SEQ ID NO: 5802 - protein, 110 aa, Artificial Sequence
  Description of Artificial Sequence: Synthetic polypeptide
DIQMTQSPSSLSASVGDRVTITCQASQDISNFLNWYQQKPGQAPKLLIYDASKLQTGVPSRFSGSGSETDFTFTISSLQPEDVATYYCQKFDNLLLTFGGGTKVELKRTV

SEQ ID NO: 5803 - protein, 110 aa, Artificial Sequence
  Description of Artificial Sequence: Synthetic polypeptide
DIQMTQSPSSVSASVGDKVTITCRASQGISTWLAWYQQKPGKAPALLIYSASRLQSGVPSRFSGSGSGTDFTLTISSLQPEDYATYYCQQANTFPFTFGPGTKVDIKRTV

SEQ ID NO: 5804 - protein, 111 aa, Artificial Sequence
  Description of Artificial Sequence: Synthetic polypeptide
EIVLTQSPGTLSLSPGERATLSCRASQTVSSSHLAWYQQKPGQAPRLLIHGSSSRATGIPERFSGSGSGPDFTLTISRLKPEDFAVYYCQYYGDSPGSFGEGTKVEIKRTV

SEQ ID NO: 5805 - protein, 111 aa, Artificial Sequence
  Description of Artificial Sequence: Synthetic polypeptide
DIVLTQSPGTLSLSPGEGATLSCRASESVSRNYLAWYQQKPGQAPRLLIYGASSRAIGIPDRFSGSGSGTDFTLTISRLEPEDFAVYCCQQYTIFPLTFGGGTKVEIKRTV

SEQ ID NO: 5806 - protein, 111 aa, Artificial Sequence
  Description of Artificial Sequence: Synthetic polypeptide
EIVMTQSPATLSVSPGERVTLSCRASQSVSTKVVWYQQKFGQAPRLLIYGASTRATGIPVRFSGSGSGTEFTLTISSLQSEDLAVYFCQQYNKWPMYTFGQGTKLEIKRTV

SEQ ID NO: 5807 - protein, 114 aa, Artificial Sequence
  Description of Artificial Sequence: Synthetic polypeptide
DIVMTQSPLSLPVTPGESASISCRSSQSLLHSNGYNYLDWYLQKPGQSPQLLIYLGSNRAPGVPDRFSGSGSGTDFTLKISRVEAEDVGVYYCMQALQTPTFGQGTKVEIKRTV

SEQ ID NO: 5808 - protein, 110 aa, Artificial Sequence
  Description of Artificial Sequence: Synthetic polypeptide
DIQMTQSPSTLSASVGDRVTITCRASESISTWLAWYQQKPGKAPNLLIYKASSLESGVPSRFSGSGSGTEFTLAISSLQPDDFATYYCQQYKSYPYTFGQGTKLELKRTV

SEQ ID NO: 5809 - protein, 114 aa, Artificial Sequence
  Description of Artificial Sequence: Synthetic polypeptide
DIVMTQSPLSLTVTPGEPASISCRSSQSLLHGNGYKYLHWYLQKPGQSPQLLIYLGSNRASGVPARFSGSGSDTDFTLKISTVETEDVGVYYCMQALQSPTFGQGTKVEIKRTV

SEQ ID NO: 5810 - protein, 110 aa, Artificial Sequence
  Description of Artificial Sequence: Synthetic polypeptide
DIQLTQSPSFLSASVGDRVTITCRASQVISSYLAWYQQTPGRAPKLLIYGASTLQTGVPSRFSGSGSGTEFTLTISSLQPEDFATYFCQQLNTYPLTFGPGTKVEIKRTV

SEQ ID NO: 5811 - protein, 110 aa, Artificial Sequence
  Description of Artificial Sequence: Synthetic polypeptide
DIQLTQSPSFLSASVGDRVTITCRASQGITSYLAWYQQKPGRAPKLLIYAASTLQSGVASRFSGSGSGTEFTLTISSLQPEDFATYYCQQFHTYPLTFGGGTKVEIKRTV

SEQ ID NO: 5812 - protein, 108 aa, Artificial Sequence
  Description of Artificial Sequence: Synthetic polypeptide
SYELTQPPSVSVSPGQTARITCSGDALADQYAYWYQQKPGQAPVMVIFKDNERPSGIPERFSGSSSGTTVTLTVSGVQSEDEADYYCQSVDSSGTYWMFGGGTKLTVL

SEQ ID NO: 5813 - protein, 108 aa, Artificial Sequence
  Description of Artificial Sequence: Synthetic polypeptide
SYELTQPPSVSVSPGQTARVTCSGDAMAEQYTYWYQQKPGQAPVLIIFKDTERPSGIPERFSGSSSGTTVTLTISGVQTEDEADYYCQSTDSSGTSWVFGGGTKLTVL

SEQ ID NO: 5814 - protein, 107 aa, Artificial Sequence
  Description of Artificial Sequence: Synthetic polypeptide
DIQMTQSPSSLSASVGDRVTITCRASQSINDCLNWYQQKPGQAPKLLISAASNLQSGVPSRFSGSGSETDFTLTISSLQPEDFAAYYCQQSFSTPLTFGGGTKVEIK

SEQ ID NO: 5815 - protein, 111 aa, Artificial Sequence
  Description of Artificial Sequence: Synthetic polypeptide
DIVMTQSPLSLPVTPGEPASISCRSSQSLVHSNGYSYLDWYLQKPGQSPQLLIYLGSNRPSGVPDRFSGSGSGTDFTLKISRVEAEDVGVYFCMQNLQTPTFGGGTKVEIK

SEQ ID NO: 5816 - protein, 107 aa, Artificial Sequence
  Description of Artificial Sequence: Synthetic polypeptide
DIQMTQSPSSLSASVGDRVTITCQASQDISDYLNWYQQKPGKAPKLLIYDASNLETGVPSRFSASGSGTDFTFTISSLQPEDIATYYCQHYHNLPPLFGGGTKVEIK

SEQ ID NO: 5817 - protein, 107 aa, Artificial Sequence
  Description of Artificial Sequence: Synthetic polypeptide
DIQMTQSPSSLSASVGDRVTITCQASQDISDYLNWYQQKPGKAPKLLIYDASNLETGVPSRFSASGSGTDFTFTISSLQPEDFATYYCQHYHNLPPLFGGGTKVEIK

SEQ ID NO: 5818 - protein, 112 aa, Artificial Sequence
  Description of Artificial Sequence: Synthetic polypeptide
DIVMTQSPLSLSVTPGQPASISCKSSQSLLQRDGKTYLYWYLQKPGQSPQLLIYEVSSRFSGVPDRFSGSGSGTDFTLKISRVEAEDVGVYYCMQGIRLPRTFGQGTKVEIK

SEQ ID NO: 5819 - protein, 105 aa, Artificial Sequence
  Description of Artificial Sequence: Synthetic polypeptide
SYELTQPPSVSVSPGQTASITCSGHELGDKYVSWYQQKPGQSPVLLIYQDTNRPAGIPERFSGSNSGSTAFLTISATQAMDEADYYCQAWDNSHWFGGGTKLTVL

SEQ ID NO: 5820 - protein, 110 aa, Artificial Sequence
  Description of Artificial Sequence: Synthetic polypeptide
SYVLTQPPSVSVAPGGTARITCGGDNIGTKGVHWYQQKPGQAPVLVMYYNSDRPTGVPERFSGSNSGNTATLTISRLEAGDEADYYCHVWDSSGSDHVEVFGGGTKLTVL

SEQ ID NO: 5821 - protein, 111 aa, Artificial Sequence
  Description of Artificial Sequence: Synthetic polypeptide
QSVLTQPPSVSGAPGQRVIISCTGSSSNIGAGHDVHWYQQLPGTAPRLLIYANTNRPSGVPDRFSASKSGNSASLVITGLQAEDEADYFCQSHDSSLSGVLFGGGTKLTVL

SEQ ID NO: 5822 - protein, 108 aa, Artificial Sequence
  Description of Artificial Sequence: Synthetic polypeptide
SSELTQDPAVSVALGHTVRITCQGDSLRSYYTNWYQQKPGQAPVLVIFGEDNRPSGIPDRFSGSSSGDTASLTITGTQAEDEADYYCNSRDSSGNLWVFGGGTKLTVL

SEQ ID NO: 5823 - protein, 111 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLSSNRASGVPDRFSGSGSGTDFTLKISRVEAEDIGIYYCMQSLQTLTFGQGTRLEIK

SEQ ID NO: 5824 - protein, 213 aa, Artificial Sequence
  Description of Artificial Sequence: Synthetic polypeptide
ELALIQPASVSVSPGQTASITCSGDKLGDKYASWYQQKPGQSPVLVIYQDSERPSGIPERFSGSNSGNTATLTISGTQAMDEADYYCQAWDSSTAVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECSM

SEQ ID NO: 5825 - protein, 111 aa, Artificial Sequence
  Description of Artificial Sequence: Synthetic polypeptide
DIQMTQSPSSLSASVGDRVTITCQASQDIKKYLNWYHQKPGKVPELLMHDASNLETGVPSRFSGRGSGTDFTLTISSLQPEDIGTYYCQQYDNLPPLTFGGGTKVEIKRTV

SEQ ID NO: 5826 - protein, 110 aa, Artificial Sequence
  Description of Artificial Sequence: Synthetic polypeptide
QSVVTQPPSVSGAPGQRVTISCTGSSSNIGAGYDVHWYQQLPGTAPKLLIYGNTNRPSGVSDRFSGSKSGTSASLAITGLQAEDEADYYCHSYDRSLSGSVFGGGTKLTV

SEQ ID NO: 5827 - protein, 107 aa, Artificial Sequence
  Description of Artificial Sequence: Synthetic polypeptide
SYVLTQPPSVSLAPGGTAAITCGRNNIGSETVHWYQQKPGQAPVLVVYDDDDRPSGIPERFSGSNSGNTATLTISRVEAGDEADYYCQVWDRSNYHQVFGGGTKLTV

SEQ ID NO: 5828 - protein, 110 aa, Artificial Sequence
  Description of Artificial Sequence: Synthetic polypeptide
DIQMTQSPSSLSAAVGDRVTITCQASQDIVNYLNWYQQKPGKAPKLLIYVASNLETGVPSRFSGSGSGTDFSLTISSLQPEDVATYYCQQYDNLPLTFGGGTKVEIKRTV

SEQ ID NO: 5829 - protein, 213 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQFSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5830 - protein, 213 aa, Artificial Sequence; identical to SEQ ID NO: 5607
  Description of Artificial Sequence: Synthetic polypeptide

SEQ ID NO: 5831 - protein, 213 aa, Artificial Sequence; identical to SEQ ID NO: 5608
  Description of Artificial Sequence: Synthetic polypeptide

SEQ ID NO: 5832 - protein, 213 aa, Artificial Sequence; identical to SEQ ID NO: 5606
  Description of Artificial Sequence: Synthetic polypeptide

SEQ ID NO: 5833 - protein, 213 aa, Artificial Sequence; identical to SEQ ID NO: 5603
  Description of Artificial Sequence: Synthetic polypeptide

SEQ ID NO: 5834 - protein, 213 aa, Artificial Sequence; identical to SEQ ID NO: 5601
  Description of Artificial Sequence: Synthetic polypeptide

SEQ ID NO: 5835 - protein, 213 aa, Artificial Sequence; identical to SEQ ID NO: 5593
  Description of Artificial Sequence: Synthetic polypeptide

SEQ ID NO: 5836 - protein, 213 aa, Artificial Sequence; identical to SEQ ID NO: 5602
  Description of Artificial Sequence: Synthetic polypeptide

SEQ ID NO: 5837 - protein, 213 aa, Artificial Sequence; identical to SEQ ID NO: 5604
  Description of Artificial Sequence: Synthetic polypeptide

SEQ ID NO: 5838 - protein, 213 aa, Artificial Sequence; identical to SEQ ID NO: 5605
  Description of Artificial Sequence: Synthetic polypeptide

SEQ ID NO: 5839 - protein, 213 aa, Artificial Sequence; identical to SEQ ID NO: 5347
  Description of Artificial Sequence: Synthetic polypeptide

SEQ ID NO: 5840 - protein, 213 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5841 - protein, 213 aa, Artificial Sequence; identical to SEQ ID NO: 5727
  Description of Artificial Sequence: Synthetic polypeptide

SEQ ID NO: 5842 - protein, 213 aa, Artificial Sequence
  Description of Artificial Sequence: Synthetic polypeptide
DIQMTQSPSTLSASVGDRVTITCSASSSVGYMHWYQQKPGKAPKLLIYDTRYLSSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5843 - protein, 450 aa, Artificial Sequence; identical to SEQ ID NO: 5493
  Description of Artificial Sequence: Synthetic polypeptide

SEQ ID NO: 5844 - protein, 213 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQGSFYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5845 - protein, 213 aa, Artificial Sequence
  Description of Artificial Sequence: Synthetic polypeptide
DIQMTQSPSTLSASVGDRVTITCSASSSVGYMHWYQQKPGKAPKLLIYDTFKLTSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5846 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTFKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5847 - protein, 213 aa, Artificial Sequence
  Description of Artificial Sequence: Synthetic polypeptide
DIQMTQSPSTLSASVGDRVTITCSASSSVGYMHWYQQKPGKAPKLLIYDTFRLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5848 - protein, 214 aa, Artificial Sequence
  Description of Artificial Sequence: Synthetic polypeptide
DIQMTQSPSTLSASVGDRVTITCSPSSRVGYMHWYQQKPGKAPKLLIYDTYRHLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5849 - protein, 213 aa, Artificial Sequence
  Description of Artificial Sequence: Synthetic polypeptide
DIQMTQSPSTLSASVGDRVTITCSLSSSVGYMHWYQQKPGKAPKLLIYDTFFHRSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5850 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTLLLDSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5851 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5852 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTSFLDSGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 5853 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQFSGYPFTFGGGTKLEIK

SEQ ID NO: 5854 - protein, 106 aa, Artificial Sequence; identical to SEQ ID NO: 5731
  Description of Artificial Sequence: Synthetic polypeptide

SEQ ID NO: 5855 - protein, 106 aa, Artificial Sequence; identical to SEQ ID NO: 5732
  Description of Artificial Sequence: Synthetic polypeptide

SEQ ID NO: 5856 - protein, 106 aa, Artificial Sequence; identical to SEQ ID NO: 5733
  Description of Artificial Sequence: Synthetic polypeptide

SEQ ID NO: 5857 - protein, 106 aa, Artificial Sequence; identical to SEQ ID NO: 5734
  Description of Artificial Sequence: Synthetic polypeptide

SEQ ID NO: 5858 - protein, 106 aa, Artificial Sequence; identical to SEQ ID NO: 5735
  Description of Artificial Sequence: Synthetic polypeptide

SEQ ID NO: 5859 - protein, 106 aa, Artificial Sequence; identical to SEQ ID NO: 5600
  Description of Artificial Sequence: Synthetic polypeptide

SEQ ID NO: 5860 - protein, 106 aa, Artificial Sequence; identical to SEQ ID NO: 5737
  Description of Artificial Sequence: Synthetic polypeptide

SEQ ID NO: 5861 - protein, 106 aa, Artificial Sequence
  Description of Artificial Sequence: Synthetic polypeptide
DIQMTQSPSTLSASVGDRVTITCSASSRVGYMHWYQQKPGKAPKLLIYDTFFLDSGVPSRFSGSGSGTEFTLTISSLQPDDFATYYCFQGSGYPFTFGGGTKVEIK

SEQ ID NO: 5862 - protein, 120 aa, Artificial Sequence; identical to SEQ ID NO: 5346
  Description of Artificial Sequence: Synthetic polypeptide

SEQ ID NO: 5863 - protein, 106 aa, Artificial Sequence; identical to SEQ ID NO: 5726
  Description of Artificial Sequence: Synthetic polypeptide

SEQ ID NO: 5864 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQGSGYPFTFGGGTKLEIK

SEQ ID NO: 5865 - protein, 106 aa, Artificial Sequence; identical to SEQ ID NO: 5334
  Description of Artificial Sequence: Synthetic polypeptide

SEQ ID NO: 5866 - protein, 7 aa, Artificial Sequence
  Description of Artificial Sequence: Synthetic peptide
DTYKQTS

SEQ ID NO: 5867 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTFKLASGVPSRFSGSGSGTEFTLTISSLQPDDFATYYCFQGSFYPFTFGGGTKLEIK

SEQ ID NO: 5868 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTFKLTSGVPSRFSGSGSGTEFTLTISSLQPDDFATYYCFQGSGYPFTFGGGTKLEIK

SEQ ID NO: 5869 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTFRLASGVPSRFSGSGSGTEFTLTISSLQPDDFATYYCFQGSGYPFTFGGGTKLEIK

SEQ ID NO: 5870 - protein, 106 aa, Artificial Sequence; identical to SEQ ID NO: 5869
  Description of Artificial Sequence: Synthetic polypeptide

SEQ ID NO: 5871 - protein, 106 aa, Artificial Sequence
  Description of Artificial Sequence: Synthetic polypeptide
DIQMTQSPSTLSASVGDRVTITCSASSSVGYMHWYQQKPGKAPKLLIYDTYRHASGVPSRFSGSGSGTEFTLTISSLQPDDFATYYCFQGSGYPFTFGGGTKLEIK

SEQ ID NO: 5872 - protein, 106 aa, Artificial Sequence
  Description of Artificial Sequence: Synthetic polypeptide
DIQMTQSPSTLSASVGDRVTITCSLSSSVGYMHWYQQKPGKAPKLLIYDTFFHRSGVPSRFSGSGSGTEFTLTISSLQPDDFATYYCFQGSGYPFTFGGGTKLEIK

SEQ ID NO: 5873 - protein, 106 aa, Artificial Sequence
  Description of Artificial Sequence: Synthetic polypeptide
DIQMTQSPSTLSASVGDRVTITCSASSRVGYMHWYQQKPGKAPKLLIYDTLLLDSGVPSRFSGSGSGTEFTLTISSLQPDDFATYYCFQGSGYPFTFGGGTKVEIK

SEQ ID NO: 5874 - protein, 106 aa, Artificial Sequence [sequence omitted]

SEQ ID NO: 5875 - protein, 106 aa, Artificial Sequence
  Description of Artificial Sequence: Synthetic polypeptide
DIQMTQSPSTLSASVGDRVTITCSASSRVGYMHWYQQKPGKAPKLLIYDTSFLDSGVPSRFSGSGSGTEFTLTISSLQPDDFATYYCFQGSGYPFTFGGGTKVEIK

SEQ ID NO: 5876 - protein, 129 aa, Artificial Sequence
  Description of Artificial Sequence: Synthetic polypeptide
QVKLLEQSGGGLVQPGGSLRLSCAVSGVTFSAYAMSWVRQAPGKGLEWVSGISGSGDSTDYADSVKGRLTISRDNSKNTLYLQMNSLRAEDTAIYYCASHLPDYWNLDYTRFFYYMDVWGKGTTVTVSS

SEQ ID NO: 5877 - protein, 120 aa, Artificial Sequence
  Description of Artificial Sequence: Synthetic polypeptide
QVKLLEESGGGLVRLAGSLRLSCAASGTTLSGYTMHWVRQAPGKGLEWVSSITGGSNFINYSDSVKGRFTISRDNAKNSLYLQMNSLTAEDTAVYYCATAPIAPPYFDHWGQGTLVTVSS

SEQ ID NO: 5878 - protein, 109 aa, Artificial Sequence
  Description of Artificial Sequence: Synthetic polypeptide
MAELTQSPGTLSLSPGERATLSCRATQSISSNYLAWYQQRPGQAPRLLIYGASNRATDIPDRFSGSGSGTDFTLTISRLEPEDFAMYYCQQYDISPYTFGQGTKLEIKR

SEQ ID NO: 5879 - protein, 109 aa, Artificial Sequence
  Description of Artificial Sequence: Synthetic polypeptide
MAELTQSPVTLSVSPGERVALSCKASQNINDNLAWYQQKPGQAPRLLIYGASSRATGIPDRFSGSGSGTDFTLTITRLEPEDFAVYYCQQYGGSPYTFGQGTKLEIKRT

SEQ ID NO: 5880 - protein, 108 aa, Artificial Sequence
  Description of Artificial Sequence: Synthetic polypeptide
MAELTQSPSSLSASVGDRVTITCRATQSVSNFLNWYQQKPGEAPTLLIYDASTSQSGVPSRFSGSGSGMDFSLTISSLQPEDLAMYYCQASINTPLFGGGTRIDMRRT

SEQ ID NO: 5881 - protein, 106 aa, Artificial Sequence
  Description of Artificial Sequence: Synthetic polypeptide
DIQMTQSPSSLSASVGDRVTITCRATQSVSNFLNWYQQKPGEAPTLLIYDASTSQSGVPSRFSGSGSGMDFSLTISSLQPEDLAMYYCQASINTPLFGGGTRIDMR

SEQ ID NO: 5882 - protein, 106 aa, Artificial Sequence
  Description of Artificial Sequence: Synthetic polypeptide
DIQMTQSPSSLSASVGDRVTITCRATQSVSNFLNWYQQKPGEAPTLLIYDASTSQSGVPSRFSGSGSGMDFSLTISSLQPEDLAMYYCQASINTPLFGGGTRVDIK

SEQ ID NO: 5883 - protein, 106 aa, Artificial Sequence
  Description of Artificial Sequence: Synthetic polypeptide
DAELTQSPSSLSASVGDRVTITCRATQSVSNFLNWYQQKPGEAPTLLIYDASTSQSGVPSRFSGSGSGMDFSLTISSLQPEDLAMYYCQASINTPLFGGGTRIDMR

SEQ ID NO: 5884 - protein, 105 aa, Artificial Sequence
  Description of Artificial Sequence: Synthetic polypeptide
AELTQSPSSLSASVGDRVTITCRATQSVSNFLNWYQQKPGEAPTLLIYDASTSQSGVPSRFSGSGSGMDFSLTISSLQPEDLAMYYCQASINTPLFGGGTRIDMR

SEQ ID NO: 5885 - protein, 106 aa, Artificial Sequence
  Description of Artificial Sequence: Synthetic polypeptide
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEI

SEQ ID NO: 5886 - protein, 107 aa, Artificial Sequence
  Description of Artificial Sequence: Synthetic polypeptide
DIQMTQSPSSLSASIGDRVTITCRASQGIRNYLAWYQQKPGKAPKLLIYAASTLQSGVPSRFSGSGSGTDFTLTISSLQPEDVATYYCQKYNSAPYAFGQGTKVEIK

SEQ ID NO: 5887 - protein, 128 aa, Artificial Sequence
  Description of Artificial Sequence: Synthetic polypeptide
METDTLLLWVLLLWVPGSTGDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 5888 - protein, 110 aa, Artificial Sequence
  Description of Artificial Sequence: Synthetic polypeptide
QSALTQPASVSGSPGQSITISCTGTSSDVGGYVYVAWYQQHPGTAPKLIIYDVSDRPSGVSNRFSGSKSGNTASLTISGLQAEDDADYYCISYTDRNTVVFGGGTKLTVL

SEQ ID NO: 5889 - protein, 107 aa, Artificial Sequence
  Description of Artificial Sequence: Synthetic polypeptide
DIQMTQSPSSLSASVGERVTITCRASQYISTHLNWYQHKPGKAPRLLIYGASHLEGGDPSRFSGSGSGTDFSLTITSLQPEDFATYYCQQTYKTPITFAQGTRLEIK

SEQ ID NO: 5890 - protein, 108 aa, Artificial Sequence
  Description of Artificial Sequence: Synthetic polypeptide
SYVLTQPPSVSVAPGRTARITCGRHNIGNENVHWYQQRPGQAPVLVIYSDSDRPSGIPERFSGSNSGNTATLSISRVEAGDEADYYCQVWDSSTDQVVFGGGTKLTVL

SEQ ID NO: 5891 - protein, 107 aa, Artificial Sequence
  Description of Artificial Sequence: Synthetic polypeptide
DIQMTQSPSSLSASVGDRVTITCRASQYISTHLNWYQQKPGKAPKLLIYGASSLQSGVPSRFSGSGSGTDFTLTISSLQPEDFATYYCQQTYKTPITFGQGTRLEIK

SEQ ID NO: 5892 - protein, 210 aa, Artificial Sequence
  Description of Artificial Sequence: Synthetic polypeptide
EIVMTQSPSSLSASIGDRVTITCQASQDISTYLNWYQQKPGQAPRLLIYGASNLETGVPSRFTGSGYGTDFSVTISSLQPEDIATYYCQQYQYLPYTFAPGTKVEIRTVAAPSVFIFPPSDEQLSGTASWCLLNNFYPREAKVQWVDNALQSGNSQESVTEQDSKDSTYSLSSTLTLSKADYEKHKVYACEVTHQGLSSPVTKSFNRGEC

SEQ ID NO: 5893 - protein, 209 aa, Artificial Sequence
  Description of Artificial Sequence: Synthetic polypeptide
QSVLTQASSVSVAPGQTARITCGANIGSQNVHWYQQKPGQAPVLWYDDRDRPSGIPDRFSGSNSGNTATLTISRVEAGDEADYYCQVWDSSRDQAVIFGGGTKLTVLGQPKAAPSVTLFPPSSEELQANATLVCLISDFYPGAVTVAWKADSSPVKAGVETTTPSQSKYAASSYLSLTPEQWKSHRSYSCQVTHEGSTVEKTIAPTECS

SEQ ID NO: 5894 - protein, 107 aa, Artificial Sequence
  Description of Artificial Sequence: Synthetic polypeptide
ETTLTQSPSSLSASVGDRVTITCRASQTVKSFLNWYQQKPGKAPKLLIYDASDLQSGVPSRFSGSGSGTDFTLTISRLQPEDFATYFCQQSYRTPLTFGQGTRVEIK

SEQ ID NO: 5895 - protein, 107 aa, Artificial Sequence
  Description of Artificial Sequence: Synthetic polypeptide
ETTLTQSPSSLSASVGDRVTITCRASQTVKSFLNWYQQKPGKAPKLLIYDASDLQSGVPSRFSGSGSGTDFTLTISRLQPEDFATYFCQQSYRTPLTFGQGTKVEIK

SEQ ID NO: 5896 - protein, 110 aa, Artificial Sequence
  Description of Artificial Sequence: Synthetic polypeptide
QSALTQPASVSGSPGQSITISCTGTSSDVGGYVYVSWYQQHPGKAPKLMIYDVSNRPSGVSNRFSGSKSGNTASLTISGLQAEDEADYYCISYTDRNTVVFGGGTKLTVL

SEQ ID NO: 5897 - protein, 116 aa, Artificial Sequence
  Description of Artificial Sequence: Synthetic polypeptide
QVQLQESGTELERSGASVKLSCTASGFNIKDYYMHWMKQRPDQGLEWIGWIDPENDDVQYAPKFQGKATMTADTSSNTAYLQLTSLTFEDTAVYFCNSWGSDFDHWGQGTTVTVSS

SEQ ID NO: 5898 - protein, 116 aa, Artificial Sequence
  Description of Artificial Sequence: Synthetic polypeptide
QVQLQESGPGLVRPSQTLSLTCTVSGFTFSDYYMHWVRQPPGRGLEWIGWIDPENDDVQYAPKFQGRVTNLVDTSKNQFSLRLSSVTAADTAVYYCARWGSDFDHWGQGTTVTVSS

SEQ ID NO: 5899 - protein, 116 aa, Artificial Sequence
  Description of Artificial Sequence: Synthetic polypeptide
QVQLQESGPGLVRPSQTLSLTCTVSGFTFSDYYMHWVRQPPGRGLEWIGWIDPENDDVQYAPKFQGRVTMLVDTSKNQFSLRLSSVTAADTAVYFCNSWGSDFDHWGQGTTVTVSS

SEQ ID NO: 5900 - protein, 116 aa, Artificial Sequence
  Description of Artificial Sequence: Synthetic polypeptide
QVQLQESGPGLVRPSQTLSLTCTVSGFNIKDYYMHWVRQPPGRGLEWIGWIDPENDDVQYAPKFQGRVTMLVDTSKNQFSLRLSSVTAADTAVYFCNSWGSDFDHWGQGTTVTVSS

SEQ ID NO: 5901 - protein, 112 aa, Artificial Sequence
  Description of Artificial Sequence: Synthetic polypeptide
DIQLTQSPSSLSASVGDRVTITCRSSQTLVHTDGNTYLEWYQQKPGKAPKLLIYRVSNRFSGVPSRFSGSGSGTDFTFTISSLQPEDIATYYCFQGSHLPRTFGQGTKVEIK

SEQ ID NO: 5902 - protein, 124 aa, Artificial Sequence
  Description of Artificial Sequence: Synthetic polypeptide
EVQLVESGGGLVQAGDSLRLSCIDSGRTFSDYPIGWFRQAPGKEREFVAAIYAIGGDVYYADSVKGRFTISRDNAKNTVYLQMSSLKPEDTAIYSCAVASGGGSIRSARRYDYWGRGTQVTVSS

SEQ ID NO: 5903 - protein, 126 aa, Artificial Sequence
  Description of Artificial Sequence: Synthetic polypeptide
EVQLVESGGGLVQAGGSLRLSCAASGGTFSSYAMGWFRQAPGKERDFVSAITWSGGSTYYADSVKGRFTISRDNAKNTVYLQMNSLKPEDTAVYYCAADDQKYDYIAYAEYEYDYWGQGTQVTVSS

SEQ ID NO: 5904 - protein, 120 aa, Artificial Sequence
  Description of Artificial Sequence: Synthetic polypeptide
EVQLVESGGDLVQPGGSLRLSCAASGFTFRGYWMTWVRQAPGKGLEWVSSINNIGEEAYYVDSVKGRFTISRDNAKNTLYLQMNSLKSEDTAVYYCVKDWASDYAGYSPNSQGTQVTVSS

SEQ ID NO: 5905 - protein, 120 aa, Artificial Sequence
  Description of Artificial Sequence: Synthetic polypeptide
EVQLVESGGGSVQPGGSLRLSCAASGFTFRGYWMSWVRQAPGKGLEWVSAINNVGGDTYYADSVKGRFTISRDNAKNMLYLQMNSLKAEDTAVYYCARDWHNDPNKNEYKGQGTQVTVSS

SEQ ID NO: 5906 - protein, 120 aa, Artificial Sequence
  Description of Artificial Sequence: Synthetic polypeptide
EVQLVESGGGLVQPGGSLRLSCAASGFTFRGYWMSWVRQAPGKGLEWVSAINNVGDEVYYADSVKGRFTISRDNAKNTLYLQMNSLKSEDTAVYYCTRDWYNDPNKNEYKGQGTQVTVSS

SEQ ID NO: 5907 - protein, 120 aa, Artificial Sequence
  Description of Artificial Sequence: Synthetic polypeptide
EVQLVESGGGLVQPGGSLRLSCAASGFTFRGYWMSWVRQAPGKGLEWVSAINNVGDEVYYADSVKGRFTISRDNAKNTLYLQMNSLKSEDTAVYYCTRDWFDDPNKNEYKGQGTQVTVSS

SEQ ID NO: 5908 - protein, 120 aa, Artificial Sequence
  Description of Artificial Sequence: Synthetic polypeptide
EVQLVESGGGLVQPGGSLRLSCAASGFTFSGYWMSWVRQAPGKGLEWVSAISNSGGETYYADSVKGRFTISRDNAKNTLYLQMNSLRSEDTAVYYCTRDWHSDPNKHEYRGQGTQVTVSS

SEQ ID NO: 5909 - protein, 120 aa, Artificial Sequence
  Description of Artificial Sequence: Synthetic polypeptide
EVQLVESGGGSVQPGGSLRLSCAASGFTFRGYWMSWVRQAPGKGLEWVSAINNLGGDTYYADSVKGRFTISRDNAKNMLYLQMNSLKAEDTAVYYCARDWYDDPNKNEYKGQGTQVTVSS

SEQ ID NO: 5910 - protein, 120 aa, Artificial Sequence
  Description of Artificial Sequence: Synthetic polypeptide
KVQLVESGGDLVQPGGSLRLSCAASGFTFRGYWMTWVRQAPGKGLEWVSSINNIGEEAYYVDSVKGRFTISRDNAKNTLYLQMNSLKSEDTAVYYCVKDWASDYAGYSPNSQGTQVTVSS

SEQ ID NO: 5911 - protein, 120 aa, Artificial Sequence; identical to SEQ ID NO: 5905
  Description of Artificial Sequence: Synthetic polypeptide

SEQ ID NO: 5912 - protein, 120 aa, Artificial Sequence; identical to SEQ ID NO: 5904
  Description of Artificial Sequence: Synthetic polypeptide

SEQ ID NO: 5913 - protein, 120 aa, Artificial Sequence
  Description of Artificial Sequence: Synthetic polypeptide
EVQLVESGGGLVQPGGSLRLSCAASGFTFSGYWMSWVRQAPGKGLEWVSAINNVGDETYYANSVKGRFTIARDNTKRTLYLQMNSLKSEDTAVYYCTRDWHSEPNKYEYKGQGTQVTVSS

SEQ ID NO: 5914 - protein, 119 aa, Artificial Sequence
  Description of Artificial Sequence: Synthetic polypeptide
EVQLVESGGGLVQPGGSLRLSCTGSGFTFSSYWMDWVRQTPGKDLEYVSGISPSGSNTDYADSVKGRFTISRDNAKNTLYLQMNSLKPEDTALYYCRRSLTLTDSPDLRSQGTQVTVSS

SEQ ID NO: 5915 - protein, 120 aa, Artificial Sequence
  Description of Artificial Sequence: Synthetic polypeptide
EVQLVESGGGLVQPGGSLRLSCAASGFTFRGYWMSWVRQAPGKGLEWVSAINNVGGETYYADSVKGRFTISRDNAKNALYLQMNSLKSEDTAVYYCARDWYNDPNKNEYKGQGTQVTVSS

SEQ ID NO: 5916 - protein, 115 aa, Artificial Sequence
  Description of Artificial Sequence: Synthetic polypeptide
EVQLVESGGGLVQAGGSLRLSCAASGSTGSSTAMGWSRQAPGKQREWVASISSAGTIRYVDSVKGRFTISRDNAKNTGYLQMNSLKPEDTAVYYCYVVGNFTTYWGRGTQVTVSS

SEQ ID NO: 5917 - protein, 120 aa, Artificial Sequence; identical to SEQ ID NO: 5909
  Description of Artificial Sequence: Synthetic polypeptide

SEQ ID NO: 5918 - protein, 120 aa, Artificial Sequence; identical to SEQ ID NO: 5906
  Description of Artificial Sequence: Synthetic polypeptide

SEQ ID NO: 5919 - protein, 120 aa, Artificial Sequence; identical to SEQ ID NO: 5906
  Description of Artificial Sequence: Synthetic polypeptide

SEQ ID NO: 5920 - protein, 120 aa, Artificial Sequence
  Description of Artificial Sequence: Synthetic polypeptide
EVQLVESGGGLVQPGGSLRLSCAASGFTFGGYWMTWVRQAPGKGLEWVSSIANDGKSTYYVDSVKGRFSISRDNAKNTLYLQMNSLKSEDTAVYYCVRDWASDYAGYSPNSQGTQVTVSS

SEQ ID NO: 5921 - protein, 120 aa, Artificial Sequence
  Description of Artificial Sequence: Synthetic polypeptide
EVQLVESGGDLVQPGGSLRLSCAASGFTFRGYWMTWVRQAPGKGLEWVSSINNIGEETYYVDSVKGRFTISRDNAKNTLYLQMNSLKSEDTAVYYCVKDWASDYAGYSPNSQGTQVTVSS

SEQ ID NO: 5922 - protein, 127 aa, Artificial Sequence
  Description of Artificial Sequence: Synthetic polypeptide
EVQLVESGGGLVQAGGSLRLSCAASGRTFSSYAMGWFRQAPGKEREFVAAISWSGRTTYYADFVKGRFTISRDNAKNTVYLQMNSLKPEDTAVYYCAADLSPGNEYGEMMEYEYDYWGEGTQVTVSS

SEQ ID NO: 5923 - protein, 120 aa, Artificial Sequence
  Description of Artificial Sequence: Synthetic polypeptide
EVQLVESGGGLVQPGGSLRLSCAASGFTFRGYWMSWVRQAPGKGLEWVSAINNVGGETYYADSVKGRFTISRDNAKNTLYLQMNSLKSEDTAAYYCARDWYNDPNKNEYKGQGTQVTVSS

SEQ ID NO: 5924 - protein, 120 aa, Artificial Sequence; identical to SEQ ID NO: 5909
  Description of Artificial Sequence: Synthetic polypeptide

SEQ ID NO: 5925 - protein, 120 aa, Artificial Sequence
  Description of Artificial Sequence: Synthetic polypeptide
EVQLVESGGGLVQPGGSLRLSCAASGFTFSGYWMSWVRQAPGKGLEWVSAINNVGGDTYYADSVKGRFTISRDNAKNTLYLQMNSLKSEDTAVYYCARDWYNDPNKNEYKGQGTQVTVSS

SEQ ID NO: 5926 - protein, 120 aa, Artificial Sequence; identical to SEQ ID NO: 5904
  Description of Artificial Sequence: Synthetic polypeptide

SEQ ID NO: 5927 - protein, 120 aa, Artificial Sequence; identical to SEQ ID NO: 5904
  Description of Artificial Sequence: Synthetic polypeptide

SEQ ID NO: 5928 - protein, 122 aa, Artificial Sequence
  Description of Artificial Sequence: Synthetic polypeptide
EVQLVESGGGLVQPGGSLRLSCAASGLIFSSYDMGWFRQAPGEERAFVGAISRSGDVRYVDPVKGRFTITRDNAKNTVYLQMNSLKPEDTAVYYCAADADGWWHRGQAYHWWGQGTQVTVSS

SEQ ID NO: 5929 - protein, 120 aa, Artificial Sequence; identical to SEQ ID NO: 5923
  Description of Artificial Sequence: Synthetic polypeptide

SEQ ID NO: 5930 - protein, 124 aa, Artificial Sequence
  Description of Artificial Sequence: Synthetic polypeptide
EVQLMESGGGLVQAGGSLRLSCAASGRTFSGYTMGWFRQAPGKGREWVAGISWSGDSTYYADSVKGRFTISREDAKNTVYLQMNSLKPGDTADYYCAAECAMYGSSWPPPCMDWGQGTQVTVSS

SEQ ID NO: 5931 - protein, 120 aa, Artificial Sequence; identical to SEQ ID NO: 5909
  Description of Artificial Sequence: Synthetic polypeptide

SEQ ID NO: 5932 - protein, 120 aa, Artificial Sequence
  Description of Artificial Sequence: Synthetic polypeptide
EVQLVESGGDLVQPGGSLRLSCAASGFTFSGYWMTWVRQAPGKGLEWVSSINNIGEEVYYVDSVKGRFTISRDNAKNTLYLQMNSLKSEDTAVYYCVKDWASDYAGYSPNSQGTQVTVSS

SEQ ID NO: 5933 - protein, 120 aa, Artificial Sequence; identical to SEQ ID NO: 5905
  Description of Artificial Sequence: Synthetic polypeptide

SEQ ID NO: 5934 - protein, 126 aa, Artificial Sequence
  Description of Artificial Sequence: Synthetic polypeptide
EVQLVESGGGLVQAGGSLRLSCAASGRTFSSSFMAWFRQVLGSDREFVGGISPGGRFTYYADSRKGRFTISGDNANNTVYLQMHSVKPEDTATYYCAADTQFSGYVPKETNEYDYWGQGTQVTVSS

SEQ ID NO: 5935 - protein, 128 aa, Artificial Sequence
  Description of Artificial Sequence: Synthetic polypeptide
EVQLVESGGGLVQAGGSLRLSCEASGRTYSRYGMGWFRQAPGKEREFVAAVSRLSGPRTVYADSVKGRFTISRDNAENTVYLQMNSLKPEDTAVYTCAAELTNRNSGAYYYAWAYDYWGQGTQVTVSS

SEQ ID NO: 5936 - protein, 121 aa, Artificial Sequence
  Description of Artificial Sequence: Synthetic polypeptide
EVQLVESGGGLVQAGGSLRLSCAASERTVIAYTMGWFRRAPGKERDFVAAMNWNGGNTIYADSAKGRFTISRDNAKNTVYLQMNSLKAEDTAVYYCAARPRFWGSYEYDYWGQGTQVTVSS

SEQ ID NO: 5937 - protein, 123 aa, Artificial Sequence
  Description of Artificial Sequence: Synthetic polypeptide
EVQLVESGGGLVQPGGSLRLSCAASGLTFRNYAIGWFRQAPGKEREGVSCINSGGSITDYLDSVKGRFAISRDNAKSTVYLQMNSLKPEDTAVYYCATDLTSSCPIYSGTDYWGKGTLVTVSS

SEQ ID NO: 5938 - protein, 125 aa, Artificial Sequence
  Description of Artificial Sequence: Synthetic polypeptide
EVQLVESGGGLVQAGGSLRLSCAASEGYFRNYMVGWFRQAPGGERMFVAAISDTAYYADSVKGRFTISRDNAKNTVYLPMNSLKPEDTAVYYCAAAPKSWGTWPLVADTRSYHFWGQGTQVTVSS

SEQ ID NO: 5939 - protein, 129 aa, Artificial Sequence
  Description of Artificial Sequence: Synthetic polypeptide
EVQLVESGGGLVQAGGSLRLSCEASGRTFSSYAMVGWFRQAPGKEREFVAAVTRWSGARTVYADSVKGRFTISRDNAENTVYLQMNSLKPEDTAVYTCAADSTNRNSGAVYYSWAYDYWGQGTQVTVSS

SEQ ID NO: 5940 - protein, 128 aa, Artificial Sequence
  Description of Artificial Sequence: Synthetic polypeptide
EVQLVESGGGLVQAGGSLRLSCEASGRTERYQAMGWFRQAPGKEREFVAVVTRWSGARTVYADSVKGRFTISRDNAENTVYLQMNSLKPEDTAVYTCAADSTNRNRGAIYYTWAYDYWGQGTQVTVSS

SEQ ID NO: 5941 - protein, 130 aa, Artificial Sequence
  Description of Artificial Sequence: Synthetic polypeptide
EVQLVESGGGLVQAGGSLRLSCATSGRTRSRYTMGWFRQAPGKEREFVAAISWSDDSTYYRDSVKGRFTISRDNAKKTVYLQMNTLKPEDTAVYYCAADSAFGTGYSDNYYSTSEEYDYWGQGTQVTVSS

SEQ ID NO: 5942 - protein, 127 aa, Artificial Sequence
  Description of Artificial Sequence: Synthetic polypeptide
EVQLVESGGGLVQAGGSLRLSCAASGPTFSADTMGWFRQAPGKEREFVATIPWSGGIAYYSDSVKGRFTMSRDNAKNTVDLQMNSLKPEDTALYYCAGSSRIYIYSDSLSERSYDYWGQGTQVTVSS

SEQ ID NO: 5943 - protein, 128 aa, Artificial Sequence
  Description of Artificial Sequence: Synthetic polypeptide
EVQLVESGGGLVQAGGSLRLSCEASGRTFSPIAMGWFRQAPGKEREFVAVVTRWSGARTVYADSVKGRFTISRDNAENTVYLQMNSLKPEDTAVYTCAADSTNRNSGAIYYTWAYDYWGQGTQVTVSS

SEQ ID NO: 5944 - protein, 112 aa, Artificial Sequence
  Description of Artificial Sequence: Synthetic polypeptide
EVQLVESGGGLVQAGGSLRLSCAASGIIFSTNHMGWYRRAPGKQRELVGTINRGDSPYYADSVKGRFTISRDNAKNMVYLQMNSLKPEDTAVYYCNAGYIYWGQGTQVTVSS

SEQ ID NO: 5945 - protein, 128 aa, Artificial Sequence
  Description of Artificial Sequence: Synthetic polypeptide
EVQLVESGGGLVQAGGSLRLSCEASGRTFSNYAMGWFRQAPGKEREFVAVVTRWSGGRTVYADSVKGRFTISRDNAENTVYLQMNSLKPEDTAVYTCAADSTNRNSGAWYYTWAYDHWGQGTQVTVSS

SEQ ID NO: 5946 - protein, 121 aa, Artificial Sequence
  Description of Artificial Sequence: Synthetic polypeptide
EVQLVESGGGLVQAGGSLRLSCTASGRTFSSYAMGWFRQTPGKEREFVASISWIGKFTYYADSVKGRFTISGENAKNTVYLQMNSLKPEDTAVYYCAAKTLVGVTTAFDRWGQGTQVTVSS

SEQ ID NO: 5947 - protein, 126 aa, Artificial Sequence
  Description of Artificial Sequence: Synthetic polypeptide
EVQLVESGGGLVQTGGSLRLSCAASGRTFSSSFMAWFRQALGSDREFVGGISPGGRITYYADSRKGRFTISRDNANNTVYLQMDSLKPEDTATYYCAADTQYSGVVLKESTDYDYWGQGTQVTVSS

SEQ ID NO: 5948 - protein, 126 aa, Artificial Sequence; identical to SEQ ID NO: 5947
  Description of Artificial Sequence: Synthetic polypeptide

SEQ ID NO: 5949 - protein, 121 aa, Artificial Sequence
  Description of Artificial Sequence: Synthetic polypeptide
EVQLVESGGGLVQAGGSLRLSCAASVRTFSNGAMGWFRQAPGKEREFVASISWSGGSTYYADSVKGRFTISGDNAKSTVYLQMNSLKPEDTAVYYCAVRGVAVTTILWNYWGQGTQVTVSS

SEQ ID NO: 5950 - protein, 121 aa, Artificial Sequence; identical to SEQ ID NO: 5936
  Description of Artificial Sequence: Synthetic polypeptide

SEQ ID NO: 5951 - protein, 121 aa, Artificial Sequence; identical to SEQ ID NO: 5936
  Description of Artificial Sequence: Synthetic polypeptide

SEQ ID NO: 5952 - protein, 125 aa, Artificial Sequence; identical to SEQ ID NO: 5938
  Description of Artificial Sequence: Synthetic polypeptide

SEQ ID NO: 5953 - protein, 125 aa, Artificial Sequence; identical to SEQ ID NO: 5938
  Description of Artificial Sequence: Synthetic polypeptide

SEQ ID NO: 5954 - protein, 128 aa, Artificial Sequence; identical to SEQ ID NO: 5945
  Description of Artificial Sequence: Synthetic polypeptide

SEQ ID NO: 5955 - protein, 125 aa, Artificial Sequence
  Description of Artificial Sequence: Synthetic polypeptide
EVQLVESGGELVQAGDSLTVSCAASGRTFSVYTMGWFRQAPMKEREFVAAISGGSIRYADSVKGRFAISSDNAGNTVYLQMNNLQPEDTAVYYCAAQGSIVFYSNWDRASQYDYWGQGTQVTVSS

SEQ ID NO: 5956 - protein, 127 aa, Artificial Sequence
  Description of Artificial Sequence: Synthetic polypeptide
EVQLVESGGGLVQPGGSLRLSCAASGFTFSSYWMYWVRQAPGKGLEWVSAISTGGGDTHYADSVKGRFTISRDNPKNTLYLQMNSLKPEDTALYYCARNRDSGSSYITFSLADFGSWGQGTQVTVSS

SEQ ID NO: 5957 - protein, 128 aa, Artificial Sequence; identical to SEQ ID NO: 5935
  Description of Artificial Sequence: Synthetic polypeptide

SEQ ID NO: 5958 - protein, 128 aa, Artificial Sequence
  Description of Artificial Sequence: Synthetic polypeptide
EVQLVESGGGLVQPGGSLRLSCAASGSSFSINAMGWFRQAPGKEREFVAVVTRWSGARTVYADSVKGRFTISRDNAENTVYLQMNSLKPEDTAVYTCAADSTNRNSGAVYYTWAYDYWGQGTQVTVSS

SEQ ID NO: 5959 - protein, 128 aa, Artificial Sequence; identical to SEQ ID NO: 5958
  Description of Artificial Sequence: Synthetic polypeptide

SEQ ID NO: 5960 - protein, 128 aa, Artificial Sequence
  Description of Artificial Sequence: Synthetic polypeptide
EMQLVESGGGLVQAGGSLRLSCEASGRSFSSYAMGWFRQAPGKEREFVAAVSRWSGPRTVYADSVKGRFTISRDNAENTVYLQMNSLKPEDTAVYTCAADSTNRNSGAVYYTWAWDYWGQGTQVTVSS

SEQ ID NO: 5961 - protein, 129 aa, Artificial Sequence
  Description of Artificial Sequence: Synthetic polypeptide
EVQLVESGGGLVQAGGSLRLSCAASGFTFDDYAIGWFRQAPGKEREGVSCIRCSDGSTYYADSVKGRFTISSDNAKNTVYLQMNSLKPEDTAVYYCAADFSLAQYKTIHRMPPYGMDYWGKGTLVTVSS

SEQ ID NO: 5962 - protein, 128 aa, Artificial Sequence
  Description of Artificial Sequence: Synthetic polypeptide
EVQLVESGGGLVQAGGSLRLSCEASGGSFSSYAMGWFRQAPGKEREFVAAVSGWIGPRPVYADSVKGRFTISRDNAENTVYLQMNSLQPEDTAVYTCAADATNRNSGAYYYTWAYDYWGQGTQVTVSS

SEQ ID NO: 5963 - protein, 128 aa, Artificial Sequence
  Description of Artificial Sequence: Synthetic polypeptide
EVQLVESGGGLVQAGGSLRLSCEASGRSFSSVAMGWFRQAPGKEREFVAALSRWSGARTVYADSVKGRFTISGDNAENTVYLQMNSLKPEDTAVYTCAADSTNRNSGAVYYTWAYDYWGQGTQVTVSS

SEQ ID NO: 5964 - protein, 128 aa, Artificial Sequence
  Description of Artificial Sequence: Synthetic polypeptide
EVQLVESGGGLVQAGGSLRLSCEASGRTFSSYAMGWFRQAPGKEREFVAVVTRWSGGRTVYABSVKGRFTISRDNAENTVYLQMNSLKPEDTAVYTCAADSTNRNSGAWYYTWAYDHWGQGTQVTVSS

SEQ ID NO: 5965 - protein, 128 aa, Artificial Sequence
  Description of Artificial Sequence: Synthetic polypeptide
EVQLVESGGGLVQAGGSLRLSCEASGRTFSRYGMGWFRQAPGKEREFVAAVSRLSGPRTVYADSVKGRFTISRDNAENTVYLQMNSLKPEDTAVYTCAAELTNRNSGAYYYTWAYDYWGQGTQVTVSS

SEQ ID NO: 5966 - protein, 128 aa, Artificial Sequence; identical to SEQ ID NO: 5943
  Description of Artificial Sequence: Synthetic polypeptide

SEQ ID NO: 5967 - protein, 128 aa, Artificial Sequence
  Description of Artificial Sequence: Synthetic polypeptide
EVQLVESGGGLVQAGGSLRLSCEASGRTFSSVAMGWFRQAPGKEREFVAAVSRWSGARTVYADSVKGRFTISGDNAENTVYLQMNSLKPEDTAVYTCAADSTNRNSGAVYYPWAYDYWGQGTQVTVSS

SEQ ID NO: 5968 - protein, 129 aa, Artificial Sequence
  Description of Artificial Sequence: Synthetic polypeptide
EVQLVESGGGLVQAGGSLRLSCEASRRTFSSYAMVGWFRQAPGKEREFVAAVTRWSGARTVYADSVKGRFTISRDNAENTVYLQMNSLKPEDTAVYTCAADSTNRNSGAVYYSWAYDYWGQGTQVTVSS

SEQ ID NO: 5969 - protein, 128 aa, Artificial Sequence
  Description of Artificial Sequence: Synthetic polypeptide
EVQLVESGGGLVQAGGSLRLSCEASGRTERYQAMGWFRQAPGKEREFVAVVTRWSGARTVYADSVKGRFTISRDNAENTVYLQMNSLKPEDTAVYTCAADSTNRNSGAIYYTWAYDYWGQGTQVTVSS

SEQ ID NO: 5970 - protein, 129 aa, Artificial Sequence; identical to SEQ ID NO: 5939
  Description of Artificial Sequence: Synthetic polypeptide

SEQ ID NO: 5971 - protein, 122 aa, Artificial Sequence
  Description of Artificial Sequence: Synthetic polypeptide
EVQLVESGGGLVQPGGSLGLSCAASGNIFSITGMGWYRQAPGNQRELVAQISHYDSTMYADSVKGRFTISRDNAKNTVYLQMNSLKPEDTAVYYCNAQIIPRVMPLRSNDYWGQGTQVTVSS

SEQ ID NO: 5972 - protein, 118 aa, Artificial Sequence
  Description of Artificial Sequence: Synthetic polypeptide
EVQLVESGGGSVQPGGSARLSCAVLGSIGSLNAMGWYRQTPGKERELVARITSLGPIMYAEFVKGRFTISRDNDKNTVYLQMNSLKPEDTAVYYCKTRWYEGIWREYWGQGTRVTVSS

SEQ ID NO: 5973 - protein, 125 aa, Artificial Sequence
  Description of Artificial Sequence: Synthetic polypeptide
EVQLVESGGGLAQPGGSLRLSCAASGFTFNDYAMGWFRQAPGKEREFVAGISWAGHNTVYAGSMKGRFTVSRDNAENTLYLQMNSLESEDTAVYYCAKSLGTIWYQKDYRAYDAWGRGTQVTVSS

SEQ ID NO: 5974 - protein, 121 aa, Artificial Sequence; identical to SEQ ID NO: 5936
  Description of Artificial Sequence: Synthetic polypeptide

SEQ ID NO: 5975 - protein, 125 aa, Artificial Sequence
  Description of Artificial Sequence: Synthetic polypeptide
EVQLVESGGGLVQAGGSLRLSCAASERTFIPYPMGWFRQAPGKEREFVGAISGGGFPTFYADSVKGRFTISRDNAENTVYLQMNSLKPEDTAVYFCARNRQGEVFRTTRLDYDSWGRGTQVTVSS

SEQ ID NO: 5976 - protein, 121 aa, Artificial Sequence
  Description of Artificial Sequence: Synthetic polypeptide
EVQLVESGGGLVQPGGSLRLSCAASGFVFSHYAMSWVRQAPGKGLEWVSDITHGGLSTTYRDSVKGRFTISRDNAKNTLYLQMDSLKPEDTAVYYCSKDRYPFVSREYDYRGQGTQVTVSS

SEQ ID NO: 5977 - protein, 119 aa, Artificial Sequence
  Description of Artificial Sequence: Synthetic polypeptide
EVQLVESGGGLVQPGGSLTLSCAASGSVFSVNAMGWHRQAPGKERELVAQLTVFGSLNYADSVKGRFSISKDSAKNTVLLQMNSLKPEDTAVYSCNLRQYESDRWRDYWGQGTQVTVSS

SEQ ID NO: 5978 - protein, 128 aa, Artificial Sequence
  Description of Artificial Sequence: Synthetic polypeptide
EVQLVESGGGLVQPGGSLRLSCAASGFTFDYYAIGWFRQAPGKEREGVSCISSSDSSTYYADSVKGRFTISRDNAKNTVYLQMNSLKPEDTAVYYCAADFSRSWGTCNEEYYYGMDYWGKGTLVTVSS

SEQ ID NO: 5979 - protein, 121 aa, Artificial Sequence
  Description of Artificial Sequence: Synthetic polypeptide
EVQLVESGGGLVQAGGSLRLSCTASGRTLSSYAMGWFRQTPGKEREFVASISWIGKFTYYADSVKGRFTISGENAKNTVYLQMNSLKPEDTAVYYCAAKTIVGGTTAWBRWGQGTQVTVSS

SEQ ID NO: 5980 - protein, 121 aa, Artificial Sequence
  Description of Artificial Sequence: Synthetic polypeptide
EVQLVESGGGLVQAGGSLRLSCTAGGDTFSSYAMGWFRQTPGKEREFVASISWIGKFTYYADSVKGRFTISGENAKNTVYLQMNSLKPEDTAVYYCAAKTIVGGTTAWDRWGQGTQVTVSS

SEQ ID NO: 5981 - protein, 121 aa, Artificial Sequence
  Description of Artificial Sequence: Synthetic polypeptide
EVQLVESGGGLVQPGGSLRLSCAASGFVFSHYAMSWVRQAPGKGLEWVSDITNGGLSTTYRDSVKGRFTISRDNAKNTLYLQMDSLKPEDTAVYYCSKDLYPFVSREYDYRGQGTQVTVSS

SEQ ID NO: 5982 - protein, 123 aa, Artificial Sequence
  Description of Artificial Sequence: Synthetic polypeptide
EVQLVESGGGLVQAGGSLRLSCAAPGRTFSTWVMGWFRQAPGKEREFVARIDWGGSSTSYADIVKGRFTISRDNAKNTVYLQMNSLKPEDAAVYYCAADLDGNGSIDYGYEYWGQGTQVTVSS

SEQ ID NO: 5983 - protein, 121 aa, Artificial Sequence
  Description of Artificial Sequence: Synthetic polypeptide
EVQLVESGGGLVQPGGSLRLSCAASGFVFSHYAMSWVRQAPGKGLEWVSBITHGGLTTTYRDSVKGRFTISRDNAKNTLYLQMDSLKPEDTAVYYCSKDRYPFISKEYDYRGQGTQVTVSS

SEQ ID NO: 5984 - protein, 119 aa, Artificial Sequence
  Description of Artificial Sequence: Synthetic polypeptide
EVQMVESGGGLVQPGGSLRLSCVASGSIARLNTMGWYRQAPGKQRELVATLSIFGVSDYADSVKGRFTISRDNAKNMVYLQMNSLKPEDTALYFCKQRQHDGGSWYDYWGQGTQVTVSS

SEQ ID NO: 5985 - protein, 123 aa, Artificial Sequence
  Description of Artificial Sequence: Synthetic polypeptide
EVQLVESGGGLVQAGGSLRLSCAASGSLFRIFTMGWYRQAPGKQRELVADITTGGSTNYADSVKGRFTISSENAKNTVYLQMNSLKAEDTAVYYCNALGRMAVAHSVSDFNSWGQGTQVTVSS

SEQ ID NO: 5986 - protein, 127 aa, Artificial Sequence; identical to SEQ ID NO: 5942
  Description of Artificial Sequence: Synthetic polypeptide

SEQ ID NO: 5987 - protein, 128 aa, Artificial Sequence
  Description of Artificial Sequence: Synthetic polypeptide
EVQLVESGGGLVQAGGSLRLSCEASGRTFSSYGMGWFRQAPGKEREFVAAVSRLSGPRTVYADSVKGRFTISRDNAENTVYLQMNSLKPEDTAVYTCAAELTNRNPGAYYYTWAYDYWGQGTQVTVSS

SEQ ID NO: 5988 - protein, 125 aa, Artificial Sequence
  Description of Artificial Sequence: Synthetic polypeptide
EVQLVESGGGLVQAGGSLRLSCAASGPTFSTMGWFRQAPGKEREFVATIPWSGGIPYYSDSVKGRFTMSRDNAKNTADLQMNSLKPEDTALYYCAGSSRIYIYSDSLSEGSYDYWGQGTQVTVSS

SEQ ID NO: 5989 - protein, 127 aa, Artificial Sequence; identical to SEQ ID NO: 5942
  Description of Artificial Sequence: Synthetic polypeptide

SEQ ID NO: 5990 - protein, 119 aa, Artificial Sequence
  Description of Artificial Sequence: Synthetic polypeptide
EVQLVESGGGLVQPGGSLRLSCAASGSIFSINAMGWYRQAPGKQRDLVAHITFGGSSYYADSVKGRFTISRDNAKNTVYLQMNSLKPEDTAVYYCNARGLGSHRVSDYWGQGTQVTVSS

SEQ ID NO: 5991 - protein, 119 aa, Artificial Sequence
  Description of Artificial Sequence: Synthetic polypeptide
EVQLVESGGGLVQPGGSLRLSCAASGSIFSINAMGWYRQAPGKQRDLVAHITFGGNSYYADSVKGRFTISRDNAKNTVYLQMNSLKPEDTAVYYCNARGLGSHRVSDYWGQGTQVTVSS

SEQ ID NO: 5992 - protein, 126 aa, Artificial Sequence
  Description of Artificial Sequence: Synthetic polypeptide
EVQLVESGGGLVQAGGSLRLSCVASGRTFNNLAMGWFRQARGKEREFVATISWSHPNTYYTDSVKGRFTISRDDAKNAVYLQMNSLKPEDTAVYYCAANPSYVYSDYLSLAGYTYWGQGTQVTVSS

SEQ ID NO: 5993 - protein, 118 aa, Artificial Sequence
  Description of Artificial Sequence: Synthetic polypeptide
EVQLVESGGGLVQAGGSLRLSCAASGSSGVINAMAWHRQAPGKERELVAHISSGGSTYYGDFVKGRFTISRDNAKDTVYLQMNSLKPEDTAVYYCHVPWMDYNRRDYWGQGTQVTVSS

SEQ ID NO: 5994 - protein, 123 aa, Artificial Sequence; identical to SEQ ID NO: 5985
  Description of Artificial Sequence: Synthetic polypeptide

SEQ ID NO: 5995 - protein, 119 aa, Artificial Sequence
  Description of Artificial Sequence: Synthetic polypeptide
EVQLVESGGGLVQPGGSLRLSCAASGSIFSINAMGWYRQAPGKQRELVAHISSGGSTYYGDSVKGRFTISRDNAKNTADLQMNSLKPEDTAVYYCNARTLGAHGIDDYWGQGTQVTVSS

SEQ ID NO: 5996 - protein, 127 aa, Artificial Sequence; identical to SEQ ID NO: 5942
  Description of Artificial Sequence: Synthetic polypeptide

SEQ ID NO: 5997 - protein, 128 aa, Artificial Sequence; identical to SEQ ID NO: 5945
  Description of Artificial Sequence: Synthetic polypeptide

SEQ ID NO: 5998 - protein, 119 aa, Artificial Sequence
  Description of Artificial Sequence: Synthetic polypeptide
EVQLVESGGGSVQPGGSLRLSCAASGSIVGINAMGWYRQALGKQRELVATIGNGGNTNYADSAKGRFSISRHNAKNSVYLQMNSLKPEDTAVYFCNLKQPENHAITNYWGQGTQVTVSS

SEQ ID NO: 5999 - protein, 119 aa, Artificial Sequence
  Description of Artificial Sequence: Synthetic polypeptide
EVQLVESGGGLVQPGGSLRLSCAASGSIFSINAMGWYRQAPGKQRELVAHITSGGSTNYADSVKGRFTISRDNAKNTVYLQMNSLKPEDTAVYYCNHRGAGAHRVDDYWGQGTQVTVSS

SEQ ID NO: 6000 - protein, 128 aa, Artificial Sequence; identical to SEQ ID NO: 5935
  Description of Artificial Sequence: Synthetic polypeptide

SEQ ID NO: 6001 - protein, 123 aa, Artificial Sequence
  Description of Artificial Sequence: Synthetic polypeptide
EVQLVESGGGLVQPGGSLKLSCAASGGFFSIDAMGWYRQAPGKQRELVAAITSGGNTNYADSVKGRFTISRDNAKNTVYLQMNSLKPEDTAVYYCNTEGREARNHGLYEYHSWGQGTQVTVSS

SEQ ID NO: 6002 - protein, 121 aa, Artificial Sequence
  Description of Artificial Sequence: Synthetic polypeptide
EVQLVESGGGLVQPGGSLRLSCAASGSIFGLNAMGWYRQVPGKERELVVSISSGGSTTYADSVKGRGRFTISRDDAKNTVYLQMNSLKPEDTGVYYCNARVPGAHYIMDYWGKGTLVTVSS

SEQ ID NO: 6003 - protein, 119 aa, Artificial Sequence
  Description of Artificial Sequence: Synthetic polypeptide
EVQLVESGGGLVQPGGSLRLSCAASGSIVGINAMGWYRQAPGKQRELVATIGNGGNTNYADSAKGRFSISRHNAKNSVYLQMNSLKPEDTAVYFCNLKQPENHAITNYWGQGTQVTVSS

SEQ ID NO: 6004 - protein, 111 aa, Artificial Sequence
  Description of Artificial Sequence: Synthetic polypeptide
EVQLVESGGGLVQAGGSLKLSCAVSARIFSTNSVDWYRQIPGKQRDWVATITPSPYTYYADSVKGRFTISRDDAKNTVYLHMNSLKPEDTAVYYCKTLDNWGQGTQVTVSS

SEQ ID NO: 6005 - protein, 126 aa, Artificial Sequence; identical to SEQ ID NO: 5934
  Description of Artificial Sequence: Synthetic polypeptide

SEQ ID NO: 6006 - protein, 126 aa, Artificial Sequence; identical to SEQ ID NO: 5934
  Description of Artificial Sequence: Synthetic polypeptide

SEQ ID NO: 6007 - protein, 124 aa, Artificial Sequence
  Description of Artificial Sequence: Synthetic polypeptide
EVQLVESGGGLVQAGGSLRLSCAASGRTGGTITMAWFRQAPGKEREFVAVISWGGITTSYADSVKGRFTISRDHAKNEQYLEMNSLKPEDTAVYFCTARAGSGLRTTINDYTYWGQGTQVTVSS

SEQ ID NO: 6008 - protein, 121 aa, Artificial Sequence
  Description of Artificial Sequence: Synthetic polypeptide
EVQLVESGAGLVQAGGSLRLSCTASGRTFSSYAMGWFRQTPGKEREFVASISWIGEFIYYADSVKGRFTISGENAKNTVYLQMNRLKPEDTAVYYCAAKTLVGDTTAFDRWGQGTQVTVSS

SEQ ID NO: 6009 - protein, 126 aa, Artificial Sequence
  Description of Artificial Sequence: Synthetic polypeptide
EVQLVKSGGGLVQAGGSLKLSCAASGRAFSSYTMGWFRQAPGKEREFVASISRDGGTPYYAYSVKGRFTISRDNAKNTVYLQMNSLGPEDTAIYTCAAKENGMFITATQEQSYDYWGQGTQVTVSS

SEQ ID NO: 6010 - protein, 121 aa, Artificial Sequence; identical to SEQ ID NO: 5981
  Description of Artificial Sequence: Synthetic polypeptide

SEQ ID NO: 6011 - protein, 121 aa, Artificial Sequence; identical to SEQ ID NO: 5936
  Description of Artificial Sequence: Synthetic polypeptide

SEQ ID NO: 6012 - protein, 126 aa, Artificial Sequence
  Description of Artificial Sequence: Synthetic polypeptide
EVQLVESGGGLVQAGGSLRLSCAASGRTFSSSFMAWFRQALGSDREFLGGISPGSRFTYYADSGKGRFTISRDNANNTVYLQMHSLKPEDTATYYCAADTEFSGYVQKESNDYDYWGQGIQVTVSS

SEQ ID NO: 6013 - protein, 115 aa, Artificial Sequence
  Description of Artificial Sequence: Synthetic polypeptide
EVQLVESGGGLVQAGGSLRLSCTVSGDTFDNSAAGWYRATSETQRELVARIRSSGSTNYADSVKGRFTVSRDNAKNTVYLQMNSLKPEDTAVYYCNVVSYGEYFWGKGTLVTVSS

SEQ ID NO: 6014 - protein, 119 aa, Artificial Sequence
  Description of Artificial Sequence: Synthetic polypeptide
EVQLVESGGGLVQPGGSLRLSCAASGFTFGDSDMSWVRQAPGEGPEWVAGINSGGGSTVYADSVKGRFTISRDNAKNMLYLQMNSLKPEDTAVYLCAQGLMAEVTAGYWGQGTQVTVSS

SEQ ID NO: 6015 - protein, 115 aa, Artificial Sequence; identical to SEQ ID NO: 6013
  Description of Artificial Sequence: Synthetic polypeptide

SEQ ID NO: 6016 - protein, 122 aa, Artificial Sequence
  Description of Artificial Sequence: Synthetic polypeptide
EVQLVESGGGLVQAGASLRLSCAASGSTLSRYGVGWFRQAPGKERELVASVDWSGSRTYYADSVKGRFTISRDNAKNTGYLQMNSLKPDDTAVYYCAADSSVVPGIEKYDDWGLGTQVTVSS

SEQ ID NO: 6017 - protein, 124 aa, Artificial Sequence
  Description of Artificial Sequence: Synthetic polypeptide
EVQLVESGGGLVQAGGSLRLSCAASGRTLSSYRMGWFRQAPGKEREFISTISWNGRSTYYADSVKGRFIFSEDNAKNTVYLQMNSLKPEDTAVYYCAAALIGGYYSDVDAWSYWGPGTQVTVSS

SEQ ID NO: 6018 - protein, 125 aa, Artificial Sequence
  Description of Artificial Sequence: Synthetic polypeptide
EVQLVKSGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS

SEQ ID NO: 6019 - protein, 118 aa, Artificial Sequence
  Description of Artificial Sequence: Synthetic polypeptide
EVQLVESGGGLVQPGGSLRLSCAASGFIFGSYDMSWVRQAPGKGPEWVSGINSGGGSTGYADSVKGRFTISRDNAKNTLYLQMNSLKPEDTAVYYCSTNLYPTTDDVWGQGTQVTVSS

SEQ ID NO: 6020 - protein, 127 aa, Artificial Sequence
  Description of Artificial Sequence: Synthetic polypeptide
EVQLVESGGGLVQAGGSLRLSCAASGGRTFSRVVAGWFRQAPGKEREFVAAISWDGVQTYYTDSVEGRFTVSRDSAKITVFLQMDNLKPEDTAVYYCAADKGVYTTVSRSMADYGAWGQGTQVTVSS

SEQ ID NO: 6021 - protein, 125 aa, Artificial Sequence
  Description of Artificial Sequence: Synthetic polypeptide
EVQLVESGGGSVQAGGSLRLSCAASGGTFNPYVMAWFRQAPGNEREFVARIRWSGGDAYYDDSVKGRFAITRDAAKNTVHLQMNSLKPEDTAVYYCAAATYGYGSYTYGGSYDLWGQGTQVTVSS

SEQ ID NO: 6022 - protein, 117 aa, Artificial Sequence
  Description of Artificial Sequence: Synthetic polypeptide
EVQLVESGGDLVQAGGSLRLSCVASGSTYSINAMGWYRQAPGKLRELVAAFRTGGSTDYADSVKGRFTISRDTAKNTVYLQMNSLKPEDTAVYYCNAEVIYYPYDYWGQGTQVTVSS

SEQ ID NO: 6023 - protein, 125 aa, Artificial Sequence; identical to SEQ ID NO: 6021
  Description of Artificial Sequence: Synthetic polypeptide

SEQ ID NO: 6024 - protein, 125 aa, Artificial Sequence
  Description of Artificial Sequence: Synthetic polypeptide
EVQLVESGGGLAQAGGSLRLSCAASGRTLTSYIMGWFRQAPGKERMFVAAISGTGTIKYYGDLVKGRFTISRDNAKNTVYLQIDSLQPEDTAVYYCAARQDYGLGYRDLHEYDYWGQGTQVTVSS

SEQ ID NO: 6025 - protein, 125 aa, Artificial Sequence
  Description of Artificial Sequence: Synthetic polypeptide
EVQLVESGGGLVQPGGSLRVSCAASGFTFNDYIMGWFRQAPGKERMFIAAISGTGTIKYYGDLVRGRFTISRDNAKNTVYLRIDSLNPEDTAVYYCAARQDYGLGYRESHEYDYWGQGTQVTVSS

SEQ ID NO: 6026 - protein, 125 aa, Artificial Sequence
  Description of Artificial Sequence: Synthetic polypeptide
EVQLVESGGGLVQPGGSLRVSCAASGFTFNSYIMGWFRQAPGKERMFIAAISGTGTIKYYGDLVGGRFTISRDNAKNTVYLRIDSLNPEDTAVYYCAARQDYGLGYRESHEYDYWGQGTQVTVSS

SEQ ID NO: 6027 - protein, 125 aa, Artificial Sequence
  Description of Artificial Sequence: Synthetic polypeptide
EVQLVESGGGLVQPGGSLRLSCAASGFTFNSYIMGWFRQAPGKERMFIAAISGTGTIKYYGDLVGGRFTISRDNAKNTVYLRIDSLNPEDTAVYYCAARQDYGLGYRESHEYDYWGQGTQVTVSS

SEQ ID NO: 6028 - protein, 124 aa, Artificial Sequence
  Description of Artificial Sequence: Synthetic polypeptide
EVQLVESGGGLVQAGGSLRLSCVASGGTFSTYGMGWFRQAAGKEREFAVAISRSGANIYYGTSTQGRFTISRDNAKNTLYLQMNSLEPEDTAVYYCAASKEWDISASGDDYDYWGQGTQVTVSS

SEQ ID NO: 6029 - protein, 114 aa, Artificial Sequence
  Description of Artificial Sequence: Synthetic polypeptide
EVQLVESGGGLVQPGGSLRLSCTAYGFIFDRSRMFWARQAPGKGFEWLSSILTAGDTWYSDSVKGRFTISRDNAKNTLYLQMNDLKSEDTAVYYCSKDGIYSSKGQGTQVTVSS

SEQ ID NO: 6030 - protein, 114 aa, Artificial Sequence; identical to SEQ ID NO: 6029
  Description of Artificial Sequence: Synthetic polypeptide

SEQ ID NO: 6031 - protein, 114 aa, Artificial Sequence
  Description of Artificial Sequence: Synthetic polypeptide
EVQLVESGGGLVQPGGSLRLSCTAYGFIFDRSRMFWARQAPGKGFEWLSSILTAGDTWYSDSVKGRFTISRDNAKNTLYLQMNDLKSEDTAVYYCSKDGIHSSKGQGTQVTVSS

SEQ ID NO: 6032 - protein, 114 aa, Artificial Sequence
  Description of Artificial Sequence: Synthetic polypeptide
EVQLVESGGDLVQPGGSLRLSCTAYGFIFDQARMFWARQAPGKGFEWLSSILTAGDTWYSDSVKGRFTISRDNAKNTLYLQMNDLKSEDTAVYYCSKDGIYSSKGQGTQVTVSS

SEQ ID NO: 6033 - protein, 114 aa, Artificial Sequence
  Description of Artificial Sequence: Synthetic polypeptide
EVQLVESGGGLVQPGGSLRLSCTAYGFIFDQSRMFWARQAPGKGFEWLSSILTAGDTWYSDSVKGRFTISRDNAKNTLYLQMNDLKSEDTAVYYCSKDGIYSSKGQGTQVTVSS

SEQ ID NO: 6034 - protein, 114 aa, Artificial Sequence
  Description of Artificial Sequence: Synthetic polypeptide
EVQLVESGGGLVQPGGSLRLSCTAYGFIFDQSRMFWARQAPGKGFEWLSSILTAGDTWHSDSVKGRFTISRDNAKNTLYLQMNDLKSEDTAVYYCSKDGIYSSKGQGTQVTVSS

SEQ ID NO: 6035 - protein, 114 aa, Artificial Sequence
  Description of Artificial Sequence: Synthetic polypeptide
EVQMVESGGDLVQPGGSLRLSCTAYGFIFDQARMFWARQAPGKGFEWLSSILTAGDTWYSDSVKGRFTISRDNAKNTLYLQMNDLKSEDTAVYYCSKDGIYSSKGQGTQVTVSS

SEQ ID NO: 6036 - protein, 114 aa, Artificial Sequence
  Description of Artificial Sequence: Synthetic polypeptide
EVQLVESGGDLVQPGGSLRLSCTAYGFIFDQARMFWARQAPGKGFEWLSSILTAGDTWYSDSVKGRFIISRDNAKNTLYLQMNDLKSEDTAVYYCSKDGIYSSKGQGTQVTVSS

SEQ ID NO: 6037 - protein, 114 aa, Artificial Sequence
  Description of Artificial Sequence: Synthetic polypeptide
EVQLVESGGGLVQPGGSLRLSCTAYGFVFDQSRMFWARQAPGKGFEWLSSILTAGDTWYSDSVKGRFTISRDNAKNTLYLQMNDLKSEDTAVYYCSKDGIHSSKGRGTQVTVSS

SEQ ID NO: 6038 - protein, 125 aa, Artificial Sequence
  Description of Artificial Sequence: Synthetic polypeptide
EVQLVESGGGLVQPGGSLRLSCEASGFTWDYYVIGWFRQAPGKEREGLSCISSDGSTTYADSVKGRFTISRDNAKNTVYLQMNSLKPEDTAVYYCATDPALGCYSGTYYPRYDYWGQGTQVTVSS

SEQ ID NO: 6039 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSVDHSTTYADSVKGRFTISWDNAKNTVYLQMNSLKPEDTAVYYCAADPALGCYSGSYYPRYDYWGQGTQVTVSS

SEQ ID NO: 6040 - protein, 126 aa, Artificial Sequence
  Description of Artificial Sequence: Synthetic polypeptide
EVQPVESGGGLVQPGGSLRLSCEASGFTWDYYVIGWFRQAPGKEREGLSCISSSDGSTTYADSVKGRFTISRDNAKNTVYLQMNSLKPEDTAVYYCAVDPALGCYSGSYYPRYDYWGQGTQVTVSS

SEQ ID NO: 6041 - protein, 126 aa, Artificial Sequence
  Description of Artificial Sequence: Synthetic polypeptide
EVQLVESGGGLVQPGGSLRLSCEASGFTWDYYVIGWFRQAPGKEREGLSCISSSDGSTTYADSVKGRFTISRDNAKNTVYLQMNSLKPEDTAVYYCAVDPALGCYSGSYYPRYDYWGQGTQVTVSS

SEQ ID NO: 6042 - protein, 126 aa, Artificial Sequence
  Description of Artificial Sequence: Synthetic polypeptide
EVQLVESGGGLVQPGGSLRLSCAASGLTLDYYAIGWFRQAPGKEREGVSCISSSDHSTTYADSVKGRFTISWDNAKNTVYLQMNSLKPEDTAVYYCAADPALGCYSGSYYPRYDYYGQGTQVTVSS

SEQ ID NO: 6043 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSSDHSTTYTDSVKGRFTISWDNAKNTLYLQMNSLKPEDTAVYYCAADPALGCYSGSYYPRYDYWGQGTQVTVSS

SEQ ID NO: 6044 - protein, 125 aa, Artificial Sequence
  Description of Artificial Sequence: Synthetic polypeptide
EVQLVESGGGLVQPGGSLRLSCEASGFTWDYYVIGWFRQAPGKEREGLSCISSDGSTTYADSVKGRFTISRDNAKNTVYLQMNSLKPEDTAVYYCATDPALGCYSGSYYPRYDYWGQGTQVTVSS

SEQ ID NO: 6045 - protein, 126 aa, Artificial Sequence
  Description of Artificial Sequence: Synthetic polypeptide
EVQLVESGGGLVQPGGSLRLSCAASGLTLDYYAIGWFRQAPGKEREGVSCISSVDHSTTYADSVKGRFTISWDSAKNTVYLQMNDLKPEDTAVYYCAADPALGCYSGSYYPRYDYWGQGTQVTVSS

SEQ ID NO: 6046 - protein, 126 aa, Artificial Sequence
  Description of Artificial Sequence: Synthetic polypeptide
EVQLVESGGGLVQPGGSLRLSCAASGFTSDYYAIGWFRQAPGKEREGVSCISSSDGSTTYADLVKGRFTISRDNAKNTVYLQMNSLQPEDTAVYYCAADPALGCYSGSYYPRYDYWGQGTQVTVSS

SEQ ID NO: 6047 - protein, 125 aa, Artificial Sequence
  Description of Artificial Sequence: Synthetic polypeptide
EVQLVESGGGLVQPGGSLRLSCAASGFTWDYYVIGWFRQAPGKEREGVSCISSDGTTTYPDSVKGRFTISRDNAKNTVYLQMNSLKPEDTAVYYCAADPALGCYSGSYYPRYDYWGQGTQVTVSS

SEQ ID NO: 6048 - protein, 126 aa, Artificial Sequence
  Description of Artificial Sequence: Synthetic polypeptide
EVQLVESGGGLVQPGGSLRLSCAASGFTWDYYAIGWFRQAPGKEREGVSCISSSDGSTTYADSVKGRFTISRDNAKNTVYLQMNSLTPEDTAVYYCAVDPALGCYSGSYYPRYDYWGQGTQVTVSS

SEQ ID NO: 6049 - protein, 125 aa, Artificial Sequence
  Description of Artificial Sequence: Synthetic polypeptide
EVQLEESGGGLVQPGGSLRLSCEASGFTWDYYVIGWFRQAPGKEREGLSCISSDGLTTYADSVKGRFTISRDNAKNTVYLQMNGLKPEDTAVYYCATDPALGCYSGSYYPRYDYWGQGTQVTVSS

SEQ ID NO: 6050 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSADHSTTYADSVKGRFTISWDNAKNTVYLQMNSLKPEDTAVYYCAADPALGCYSGNYYPRYDYWGQGTQVTVSS

SEQ ID NO: 6051 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSADHSTTYADSVKGRFTISWDNAKNTVYLQMNSLKPEDTAVYYCAADPALGCYSGSYYPRYDYWGQGTQVTVSS

SEQ ID NO: 6052 - protein, 126 aa, Artificial Sequence
  Description of Artificial Sequence: Synthetic polypeptide
EVQLVESGGGLVQPGGSLRLSCAASGFTWDYYVIGWFRQAPGKEREGVSCISSSDGSTTYADFVKGRFTISRDNAKNTVYLQMNSLTPEDTAVYYCAADPALGCYSGNYYPRYDYWGQGTQVTVSS

SEQ ID NO: 6053 - protein, 125 aa, Artificial Sequence
  Description of Artificial Sequence: Synthetic polypeptide
EVQLVESGGGLVQPGGSVRLSCAASGFTWDYYVIGWFRQAPGKEREGLSCISSDGSTTYADSVKGRFTISRDNAKNTVYLQMNSLKPEDTAVYYCATDPALGCYSGSYYPRYDYWGQGTQVTVSS

SEQ ID NO: 6054 - protein, 125 aa, Artificial Sequence
  Description of Artificial Sequence: Synthetic polypeptide
EVQLVESGGGLVQPGGSLRLSCEASGFTWDYYVIGWFRQAPGKEREGLSCISSDGSTTYADSVKGRFTISRDNAKNTVYLQMNSLEPEDTAVYYCATDPALGCYSGSYYPRYDYWGQGTQVTVSS

SEQ ID NO: 6055 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSVDHSTTYADSVKGRFTISWDNAKNMVYLQMNSLKPEDTAVYYCAADPALGCYSGNYYPRYDYWGQGTQVTVSS

SEQ ID NO: 6056 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSSDHSTTYADSVKGRFTISWDNAKNTVYLQMNSLKPEDTAVYYCAADPALGCYSGSYYPRYDYWGQGTQVTVSS

SEQ ID NO: 6057 - protein, 126 aa, Artificial Sequence
  Description of Artificial Sequence: Synthetic polypeptide
EVQLVESGGGLVQPGGSLRLSCAASGLTLDYYAIGWFRQAPGKEREGVSCISSTDHSTTYADSVKGRFTISWDNAKKMVYLQMNKLKPEDTAVYYCAADPALGCYSGSYYPRYDYWGQGTQVTVSS

SEQ ID NO: 6058 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSSDHTTTYADSVKGRFTISWDNAKNTLYLQMNSLKPEDTAVYYCAADPALGCYSGSYYPRYDFWGQGTQVTVSS

SEQ ID NO: 6059 - protein, 126 aa, Artificial Sequence
  Description of Artificial Sequence: Synthetic polypeptide
EVQLVESGGGLVQPGGSLRLSCAASGFTWDYYAIGWFRQAPGKEREGVSCISSSDGSTTYADSVKGRFTISRDNTKNTVYLQMNSLTPEDTAIYYCAVDPALGCYSGNYYPRYDYWGQGTQVTVSS

SEQ ID NO: 6060 - protein, 126 aa, Artificial Sequence
  Description of Artificial Sequence: Synthetic polypeptide
EVQLVESGGGLVQPGGSLRLSCAASGLTLDYYALGWFRQAPGKEREGVACIDSSDHSTTYADSVKGRFTISWDNAKNTVYLQMSSLKPEDTAVYHCAADPALGCYSGSYYPRYDYWGQGTQVTVSS

SEQ ID NO: 6061 - protein, 125 aa, Artificial Sequence
  Description of Artificial Sequence: Synthetic polypeptide
EVQLVESGGGLVQPGGSLRLSCEASGFTWDYYVIGWFRQAPGKEREGLSCISSDGSTTYADSVKGRFTISRDNAKNMVYLQMNSLKPEDTAVYYCATDPALGCYSGSYYPRYDYWGQGTQVTVSS

SEQ ID NO: 6062 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSSDHSTTYTDSVKGRFTISWDNAKNTLYLQMNSLKPGDTAVYYCAADPALGCYSGSYYPRYDYWGQGTQVTVSS

SEQ ID NO: 6063 - protein, 126 aa, Artificial Sequence
  Description of Artificial Sequence: Synthetic polypeptide
EVQLVESGGGLVQPGGSLRLSCAASGFTWDYYVIGWFRQAPGKEREGVSCISSSDGSTTYADFVKGRFTISRDNAKNTVYLQMNNLTPEDTAVYYCATDPALGCYSGNYYPRYDYWGQGTQVTVSS

SEQ ID NO: 6064 - protein, 126 aa, Artificial Sequence
  Description of Artificial Sequence: Synthetic polypeptide
EVQLVESGGGLVQPGGSLRLSCAASGFTWDYYVIGWFRQAPGKEREGVSCISSSDGSTTYADFVKGRFTISRDNARNTVYLQMNNLTPEDTAVYYCATDPALGCYSGNYYPRYDYWGQGTQVTVSS

SEQ ID NO: 6065 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSVDHSTTYADSVKGRFTISWDNAKNIVYLQMNSLKPEDTAVYYCAADPALGCYSGSYYPRYDYWGQGTQVTVSS

SEQ ID NO: 6066 - protein, 126 aa, Artificial Sequence
  Description of Artificial Sequence: Synthetic polypeptide
EVQLVESGGGLVQPGGSLRLSCAASGLTLDYYAIGWFRQAPGKEREGVSCISSVDHSTTYADPVKGRFTISWDSAKNTVYLQMNDLKPEDTAVYYCAADPALGCYSGSYYPRYDYWGQGTQVTVSS

SEQ ID NO: 6067 - protein, 126 aa, Artificial Sequence
  Description of Artificial Sequence: Synthetic polypeptide
EVQLVESGGGLVQPGGSLRLSCAASGLTLDYYAIGWFRQAPGKEREGVSCISSSDHSTTYADSVKGRFTISWDNAKKVVYLQMNSLKPEDTAVYYCAADPALGCYSGSYYPRYDYWGQGTQVTVSS

SEQ ID NO: 6068 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSVDHSTTYADSVKGRFTISWDNAKNMVYLQMNSLKPEDTAVYYCAADPALGCYSGSYYPRYDYWGQGTQVTVSS

SEQ ID NO: 6069 - protein, 125 aa, Artificial Sequence
  Description of Artificial Sequence: Synthetic polypeptide
EVQLVESGGGLVQPGGSLRLSCEASGFTWDYYVIGWFRQAPGKEREGLSCISSDGLTTYADSVKGRFTISRDNAKNTVYLQMNGLKPEDTAVYYCATDPALGCYSGSYYPRYDYWGQGTQVTVSS

SEQ ID NO: 6070 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSSDHSTTYADSVKGRFTISWDNAKNTLYLQMNSLKPEDTAVYYCAADPALGCYSGSYYPRYDYWGQGTQVTVSS

SEQ ID NO: 6071 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSVDHSTTYADSVKGQFTISWDNAKNMVYLQMNSLKPEDTAVYYCAADPALGCYSGSYYPRYDYWGQGTQVTVSS

SEQ ID NO: 6072 - protein, 126 aa, Artificial Sequence
  Description of Artificial Sequence: Synthetic polypeptide
EVQLVESGGGLVQPGGSLRLSCVASGLTLDYYALGWFRQAPGKEREGVSCISSSDHSTTYADSVKGRFTISWDNAKNTVYLQMNSLKPEDTAVYYCAADPALGCYSGSYYPRYDYWGQGTQVTVSS

SEQ ID NO: 6073 - protein, 126 aa, Artificial Sequence
  Description of Artificial Sequence: Synthetic polypeptide
EVQLVESGGGLVQPGGSLRLSCAASGFTWDYYAIGWFRQAPGKEREGVSCISSSDGSTTYADSVKGRFTISRDNTKNTVYLQMNSLTPEDTAVYYCAVDPALGCYSGNYYPRYDYWGQGTQVTVSS

SEQ ID NO: 6074 - protein, 126 aa, Artificial Sequence; identical to SEQ ID NO: 6058
  Description of Artificial Sequence: Synthetic polypeptide

SEQ ID NO: 6075 - protein, 126 aa, Artificial Sequence
  Description of Artificial Sequence: Synthetic polypeptide
EVQLVESGGGLVQPGGSLRLSCAASGLTLDYYALGWFRQAPGKGREGVSCISSSDHTTTYADSVKGRFTISWDNAKNTLYLQMNSLKPEDTAVYYCAADPALGCYSGNYYPRYDFWGQGTQVTVSS

SEQ ID NO: 6076 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSSDHTTTYADSVKGRFTISWDNAKNTLYLQMNSLKPEDTAVYYCAADPALGCYSGNYYPRYDFWGQGTQVTVSS

SEQ ID NO: 6077 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSSDHTTTYTDSVKGRFTISWDNAKNTLYLQMNSLKPEDTAVYYCAADPALGCYSGSYYPRYDFWGQGTQVTVSS

SEQ ID NO: 6078 - protein, 126 aa, Artificial Sequence
  Description of Artificial Sequence: Synthetic polypeptide
EVQLVESGGGLVQPGGSLRLSCAASGLTLDYYALGWFRQAPGKEREGVSCISSSDHTTTYADSVKGRFTISWDNAKNTLYLQMTSLKPEDTAVYYCAADPALGCYSGSYYPRYDFWGQGTQVTVSS

SEQ ID NO: 6079 - protein, 126 aa, Artificial Sequence
  Description of Artificial Sequence: Synthetic polypeptide
EVQLMESGGGLVQPGGSLRLSCATSGFTLDYYVIGWFRQAPGKEREGVSCMSSSGDITTYAPSVKGRFTISRDNAKNMVYLQMTSLKPEDTAVYYCAADFALGCYSGSYVPRYDYWGQGTQVTVSS

SEQ ID NO: 6080 - protein, 126 aa, Artificial Sequence
  Description of Artificial Sequence: Synthetic polypeptide
EVQLVESGGGLVQPGGSLRLSCATSGFTLDYYVIGWFRQAPGKEREGVSCMSSSGDSTTYADSVKGRFTISRDNAKNMVYLQMTSLKPEDTAVYYCAADFALGCYSGSYYPRYDYWGQGTQVTVSS

SEQ ID NO: 6081 - protein, 126 aa, Artificial Sequence
  Description of Artificial Sequence: Synthetic polypeptide
EVQLVESRGGLVQPGGSLRLSCATSGFTLDYYVIGWFRQAPGKEREGVSCMSSSGDSTTYADSVKGRFTISRDTAKNMVYLQMTSLKPEDTAVYYCAADFALGCYSGSYYPRYDYWGQGTQVTVSS

SEQ ID NO: 6082 - protein, 126 aa, Artificial Sequence
  Description of Artificial Sequence: Synthetic polypeptide
EVQLVESGGGLVRPGGSLRLSCATSGFTEDYYVIGWFRQAPGKEREGVSCMSSSGDSTTYADSVKGRFTISRDNAKNMVYLQMTSLKPEDTAVYYCAADFALGCYSGSYYPRYDYWGQGTQVTVSS

SEQ ID NO: 6083 - protein, 126 aa, Artificial Sequence; identical to SEQ ID NO: 6082
  Description of Artificial Sequence: Synthetic polypeptide

SEQ ID NO: 6084 - protein, 126 aa, Artificial Sequence
  Description of Artificial Sequence: Synthetic polypeptide
EVQLVESGGGLVQPGGSLRLSCATSGFTEDYYVIGWFRQAPGKEREGVSCMSSSGDSTTYADSVKGRFTISRDNAKNMVYLQMTSLKPEDTAVYYCAADFALGCYSGSYYPRYDYWGQGTQVTVSS

SEQ ID NO: 6085 - protein, 126 aa, Artificial Sequence
  Description of Artificial Sequence: Synthetic polypeptide
EVQLVESGGGLVQPGGSLRLSCATSGFTLDYYVIGWFRQAPGKEREGVSCMSSSGDSTTYADSVKGRFTISRDTAKNMVYLQMTSLKPEDTAVYYCAADFALGCYSGSYYPRYDYWGQGTQVTVSS

SEQ ID NO: 6086 - protein, 126 aa, Artificial Sequence
  Description of Artificial Sequence: Synthetic polypeptide
EVQLVESGGGLVQPGGSLRLSCATSGLTLDYYVIGWFRQVPGKEREGVSCMSSSGDSTTYADSVKGRFTISRDNAKNMVYLQMTSLMPEDTAVYYCAADFALGCYSGSYYPRYDYWGQGTQVTVSS

SEQ ID NO: 6087 - protein, 126 aa, Artificial Sequence
  Description of Artificial Sequence: Synthetic polypeptide
EVQLVESGGGLVQPGGSLRLSCATSGFTMDYYVIGWFRQAPGKEREGVSCMSSSGDSTTYAPSVKGRFTISRDNAKNMVYLQMTSLKPEDTAVYYCAADFALGCYSGSYYPRYDYWGQGTQVTVSS

SEQ ID NO: 6088 - protein, 126 aa, Artificial Sequence
  Description of Artificial Sequence: Synthetic polypeptide
EVQLVESGGGLVQPGGSLTLSCATSGLTLDYYVIGWFRQAPGKEREGVSCMSSSGDSTTYADSVKGRFTISRDNAKNMVYLQMTSLKPEDTAIYYCAADFALGCYSGSYYPRYDYWGQGTQVTVSS

SEQ ID NO: 6089 - protein, 126 aa, Artificial Sequence
  Description of Artificial Sequence: Synthetic polypeptide
EVQLVESGGGLVQPGGSLRLSCATSGFTEDYYVIGWFRQAPGKEREGVSCMSSSGDSTTYADSVQGRFTISRDNAKNMVYLQMTSLKPEDTAVYYCAADFALGCYSGSYYPRYDYWGQGTQVTVSS

SEQ ID NO: 6090 - protein, 126 aa, Artificial Sequence
  Description of Artificial Sequence: Synthetic polypeptide
EVQLVESGGGLVQPGGSLRLSCATSGFTLDYYVIGWFRQAPGKEREGVSCMSSSGDITTYAPSVKGRFTISRDNAKNMVYLQMTSLKPEDTAVYYCAADFALGCYSGSYVPRYDYWGQGTQVTVSS

SEQ ID NO: 6091 - protein, 126 aa, Artificial Sequence
  Description of Artificial Sequence: Synthetic polypeptide
EVQLVESGGGLVQPGGSLRLSCATSGFTLDYYVIGWFRQAPGKEREGVSCMSSSGDITTYAPSVKGRFTISRDNAKNMVYLQMTSLKPEDTAVYYCAADFPLGCYSGSYVPRYDYWGQGTQVTVSS

SEQ ID NO: 6092 - protein, 133 aa, Artificial Sequence
  Description of Artificial Sequence: Synthetic polypeptide
EVQLVESGGGLVQAGGSLRLSCAASGFTFDDYAIGWFRQAPGKEREAVSCISSSDGTTYYADSVKGRFTISSDNAKNTVYLTMNNLKPEDTAVYYCAADRLSTVVGCLYYGGSYYPRTTIDYWGKGTLVTVSS

SEQ ID NO: 6093 - protein, 133 aa, Artificial Sequence
  Description of Artificial Sequence: Synthetic polypeptide
EVQLVESGGGLVQAGGSLRLSCAASGFTFDDYAIGWFRQAPGKEREAVSCISSSDGSTYYTDSVKGRFTISSDNAKNTVYLTMNSLKPEDTAVYYCAADLLSTVVGCLYYRGSYYPRTTADYWGKGTLVTVSS

SEQ ID NO: 6094 - protein, 133 aa, Artificial Sequence
  Description of Artificial Sequence: Synthetic polypeptide
EVQLVESGGGLVQAGGSLRLSCAASGFTFDDYAIGWFRQAPGKEREAVSCISSSDGSTYYADSVKGRFTISSDNAKNMVYLQMNSLKPEDTAVYYCAADLLRTAVGCLDYRGTYYPRTTMDYRGKGTLVTVSS

SEQ ID NO: 6095 - protein, 133 aa, Artificial Sequence
  Description of Artificial Sequence: Synthetic polypeptide
EVQLVESGGGLVQAGGSLRLSCAASGFTFDDYAIGWFRQAPGKEREAVSCISSSDSSTYYTDSVKGRFTISSDNAKNTVYLTMNSLKPEDTAVYYCAADLLSTVVGCLYYRGSYYPRTTADYWGKGTLVTVSS

SEQ ID NO: 6096 - protein, 133 aa, Artificial Sequence
  Description of Artificial Sequence: Synthetic polypeptide
EVQLVESGGGLVQAGGSLRLSCAASGFTFDDYAIGWFRQAPGKEREAVSCISSSDGVTYYSDSVKGRFTISSDNAKNTVYLQMNSLKPEDTAVYYCAADLLRTAVGCLYYRGTYYPRTTMDYRGKGTLVTVSS

SEQ ID NO: 6097 - protein, 133 aa, Artificial Sequence
  Description of Artificial Sequence: Synthetic polypeptide
EVQLVESGGGLVQAGGSLRLSCAASGFTFDDYAIGWFRQAPGKEREAVSCISSSDGSTYYTDSVKGRFTISSDNAKNTVYLTMNSLKPEDTAVYYCAADQLSTVVGCFYYRGSYYPRTTADYWGKGTLVTVSS

SEQ ID NO: 6098 - protein, 133 aa, Artificial Sequence
  Description of Artificial Sequence: Synthetic polypeptide
EVQLVESGGGLVQAGGSLRLSCAASGLTFDDYAIGWFRQAPGKEREAVSCISSSDGSTYYADSVKGRFTISRDNAKNTVYLQMNSLKPEDTAVYYCAADLLATAVGCLYYRGTYYPRTTMDYWGKGTLVTVSS

SEQ ID NO: 6099 - protein, 133 aa, Artificial Sequence
  Description of Artificial Sequence: Synthetic polypeptide
EVQLVESGGGLVQAGGSLRLSCAASGFTFDDYAIGWFRQAPGKEREAVSCISSSDGTTYYADSVKGRFTISSDNAKNTVYLAMNNLKPGDTAVYYCAADLLSTVVGCLYYGGSYYPRTTIDYWGKGTLVTVSS

SEQ ID NO: 6100 - protein, 133 aa, Artificial Sequence
  Description of Artificial Sequence: Synthetic polypeptide
EVQLVESGGGLVQAGGSLRLSCAASGFTFDDYAIGWFRQAPGKEREGVSCIDSSDGSTYYADSVKGRFTISSDNAKNTVYLQMNSLKPEDTAVYYCAADLLRTVVGCLYYGGRYSPRTTTDYWGKGTLVTVSS

SEQ ID NO: 6101 - protein, 133 aa, Artificial Sequence
  Description of Artificial Sequence: Synthetic polypeptide
EVQLVESGGGLVQAGGSLRLSCAASGFTFDDYAIGWFRQAPGKEREAVSCISSSDGTTYYADSVKGRFTISSDNAKNTVYLTMNNLKPEDTAVYYCAADLLSTVVGCLYYGGSYYPRTTIDYWGKGTLVTVSS

SEQ ID NO: 6102 - protein, 132 aa, Artificial Sequence
  Description of Artificial Sequence: Synthetic polypeptide
EVQLVESGGGLVQAGGSLRLSCAASGFTFDDYAIGWFRQAPGKEREAVSCISSSDGTYYADSVKGRFTISSDNAKNTVYLQMNSLKPEDTAVYYCAADLLRTAVGCLHYRGSYYPRTTIDYWGKGTLVTVSS

SEQ ID NO: 6103 - protein, 133 aa, Artificial Sequence
  Description of Artificial Sequence: Synthetic polypeptide
EVQLVESGGGKVQPGGSLRLSCAASGFTFDDYAIGWFRQAPGKEREGVSCIDSSDGSTYYADSVKGRFTISKDNAKNTVYLQMNSLKPEDTAVYYCAADLLRTVVGCLYYGGSYSPRTTMDYWGKGTLVTVSS

SEQ ID NO: 6104 - protein, 122 aa, Artificial Sequence
  Description of Artificial Sequence: Synthetic polypeptide
EVQLVESGGGLVQAGGSLRLSCAASGRTFSSYAMGWFRQAPGKEREFVGAISGSGSNIYYANSMPGRITIFRDNAKNTAYLQMNSLNPEDTAVYYCAAAPTLVEITTTPTYWGQGTQVTVSS

SEQ ID NO: 6105 - protein, 122 aa, Artificial Sequence
  Description of Artificial Sequence: Synthetic polypeptide
EVQLVQSGGGLVQAGGSLRLSCAASGRTFSSYAMGWFRQAPGKEREFVGAISGSGSNIYYANAMPGRITIFRDNAKNTVYLQMNSLNPEDTAVYYCAAAPTLVEITPTPTYWGQGTQVTVSS

SEQ ID NO: 6106 - protein, 122 aa, Artificial Sequence
  Description of Artificial Sequence: Synthetic polypeptide
EVQLVESGGGLVQAGGSLRLSCAASGRTFSSYAMGWFRQAPGKEREFVGAISGSGSNIYYADSMPGRITIFRDNAKNTVYLQMNSLNPEDTAVYYCAAAPTLVEITPTPTYWGQGTQVTVSS

SEQ ID NO: 6107 - protein, 122 aa, Artificial Sequence
  Description of Artificial Sequence: Synthetic polypeptide
EVQLVESGGGLVQAGGSLRLSCAASGRTFSSYAMGWFRQAPGKEREFVGAISESGSNIYYANAMPGRITIFRDNAKNTAYLQMNSLNPEDTAVYYCAAAPTLVEITTTPTYWGQGTQVTVSS

SEQ ID NO: 6108 - protein, 122 aa, Artificial Sequence
  Description of Artificial Sequence: Synthetic polypeptide
EVQLVESGGGLVQAGGSLRLSCAASGRTFSSYAMGWFRQAPGKEREFVGAISGSGSNIYYANSMPGRITIFRDNAKNTVYLQMNSLNPEDTAVYYCAAAPTLVEITPTPTYWGRGTRVTVSS

SEQ ID NO: 6109 - protein, 123 aa, Artificial Sequence
  Description of Artificial Sequence: Synthetic polypeptide
EVQLVESGGGLVQAGGSLRLSCADHGRTLAYYTAGWFRQAPGKEREFVASISRSSGSTRYADSVRGRFTISRDNAKNTVYLQMNSLKPEDTAAYYCATTDDYINTTPALYRNWGQGTQVTVSS

SEQ ID NO: 6110 - protein, 122 aa, Artificial Sequence
  Description of Artificial Sequence: Synthetic polypeptide
EVQLVESGGGLVQAGDSLRLSCTASERTFRNDAGGWFRQAPGKEREFVAAITSGGSTDYANSVKGRFTISRDNAKNTVYLQMNSLRPEDTAVYYCAADSNVNTVKLGWGRYWGQGTQVTVSS

SEQ ID NO: 6111 - protein, 122 aa, Artificial Sequence
  Description of Artificial Sequence: Synthetic polypeptide
EVQLVESGGGLVQAGDSLRLSCTASERTFGNDAGGWFRQAPGKERDFVAAITSGGSTDYANSVKGRFTISRDNAKNTVYLQMNSLRPEDTAVYYCAADSSVNTVKLGWGRYWGQGTQVTVSS

SEQ ID NO: 6112 - protein, 122 aa, Artificial Sequence
  Description of Artificial Sequence: Synthetic polypeptide
EVQLVESGGGLVQAGDSLRLSCTASERTFGNDAGGWFRQAPGKERDFVAAITSGGSTDYANSVKGRFTISRDNAKNTVYLQMNSLRPEDTAVYYCAADSNVNTVKLGWGRYWGQGTQVTVSS

SEQ ID NO: 6113 - protein, 122 aa, Artificial Sequence
  Description of Artificial Sequence: Synthetic polypeptide
EVQLVESGGGLVHPGGSLRLSCAASERTFGNDAGGWFRQAPGKERDFVAAITSGGSTDYANSVKGRFTISRDNAKNTVYLQMNSLRPEDTAVYYCAADSNVNTVKLGWGRYWGQGTQVTVSS

SEQ ID NO: 6114 - protein, 123 aa, Artificial Sequence
  Description of Artificial Sequence: Synthetic polypeptide
EVQLVESGGGLVQPGGSLRLSCAASGSIWSITSMGWYRQAAGKQRELVAKIISGGSTNYADSVKGRFTISRDNAKNTVYLQMNSLKPEDTAVYYCNADVRVAEKHTAYEANYWGQGTQVTVSS

SEQ ID NO: 6115 - protein, 118 aa, Artificial Sequence
  Description of Artificial Sequence: Synthetic polypeptide
EVQLVESGGGLVQPGGSLSVSCAASGTIFAINAMGWYRQVPGKERELVAVMRNPGGTNYADSVKGRFTISRDNAKNTVYLQMNSLKPEDTAVYYCYLKMYGGNWYTYWGQGTQVTVSS

SEQ ID NO: 6116 - protein, 128 aa, Artificial Sequence
  Description of Artificial Sequence: Synthetic polypeptide
EVQLVESGGGLVQAGASLRLSCAASGLAFSRYAMGWFRQAPGKERESVAAISSSGDNIYYADSVKGQFTMSRDNAKSSVYLQMINLKPEDTAVYYCAAATSPLFVASDYFDASRYDYWGQGTQVTVSS

SEQ ID NO: 6117 - protein, 128 aa, Artificial Sequence
  Description of Artificial Sequence: Synthetic polypeptide
EVQLVESGGGLVHAGASLRLSCVASGLAFSRYAMGWFRQAPGKERESVAAISSSGDNIYYSRSVKGILSISRDNAKSAVYLQMNNLKPEDTAVYYCAAAASTLFIASDYFEASRYDYWGQGTQVTVSS

SEQ ID NO: 6118 - protein, 127 aa, Artificial Sequence
  Description of Artificial Sequence: Synthetic polypeptide
EVQLVESGGGLVQAGASLRLSCAASGLAFSRYAMGWFRQAPGKERESVAAISSSGDNIYYADSVKGQFTMSRDNAKSSVYLQMINLKPEDTAVYYCAATSPLFVASDYFEASRYGYWGQGTQVTVSS

SEQ ID NO: 6119 - protein, 127 aa, Artificial Sequence
  Description of Artificial Sequence: Synthetic polypeptide
EVQLVESGGGLVQAGASLRLSCAASGLAFSRYAMGWFRQAPGKERESVAAISSSGDNIYYPDSVKGQFTMSRDNAKSSVYLQMINLKPEDTAVYYCAAASPLFVASDYFEASRYGYWGQGTQVTVSS

SEQ ID NO: 6120 - protein, 128 aa, Artificial Sequence
  Description of Artificial Sequence: Synthetic polypeptide
EVQLVESGGGLVHAGASLRLSCVASGLAFSRYAMGWFRQAPGKERESVAAISSSGDNIYYSRSVKGILSISRDNAKSAVYLQMNNLKPEDTAVYYCAAAASTLFVASDYFEASRYDYWGQGTQVTVSS

SEQ ID NO: 6121 - protein, 127 aa, Artificial Sequence
  Description of Artificial Sequence: Synthetic polypeptide
EVQLVESGGGLVQAGASLRLSCAASGLAFSRYAMGWFRQAPGKERESVAAISSSGDNIYYADSVKGQFTMSRDNAKSSVYLQMINLEPEDTAVYYCAATSPLFVASDYFEASRYGYWGQGTQVTVSS

SEQ ID NO: 6122 - protein, 124 aa, Artificial Sequence
  Description of Artificial Sequence: Synthetic polypeptide
EVQLVESGGGLVQAGGSLRLSCAASVGTFSNYDIGWFRQAPGKGREFVARISSAGSNLYYGSSMPGRITISRDNAKNTVYLQMNSLKPEDTAIYYCAADNTAYGSFKADDYDYWGQGTQVTVSS

SEQ ID NO: 6123 - protein, 124 aa, Artificial Sequence
  Description of Artificial Sequence: Synthetic polypeptide
EVQLVESGGGLVQPGGSLRLSCAASAGTFSNYDIGWFRQAPGKGREFVARISSGGSNIYYGNSMPGRITISRDNAKNTVYLQMNSLTPEDTAIYYCAADSTAYGSFKADDYDYWGQGTQVTVSS

SEQ ID NO: 6124 - protein, 124 aa, Artificial Sequence
  Description of Artificial Sequence: Synthetic polypeptide
EVQLVESGGGLVQPGGSLRLSCAASAGTLSNYDIGWFRQAPGKGREFVARISSAGSNLYYGTSMPGRITISRDNAKNTVYLQMNSLKPEDTAIYYCAADSTAYGSFKADDYDYWGQGTQVTVSS

SEQ ID NO: 6125 - protein, 128 aa, Artificial Sequence
  Description of Artificial Sequence: Synthetic polypeptide
EVQLVESGGGLVQPGGSLRLSCAASGFTLDYYAIGWFRQAPGKEREGVSCISSWDGSTYYADSVKGRFTISRDNAKNTVYLQMNSLKPEDTAVYYCATDLTDSLCSYYDYMRPENDYWGQGTQVTVSS

SEQ ID NO: 6126 - protein, 128 aa, Artificial Sequence
  Description of Artificial Sequence: Synthetic polypeptide
EVQLVESGGGLVQPGESLRLSCAASGFTLAYYAIGWFRQAPGKEREGVSCISSWDGSTYYADSVKGRFTISRDNAKNTVYLQMNSLKPEDTAVYYCATDLTDSLCSYYHYMRPENDYWGQGTQVTVSS

SEQ ID NO: 6127 - protein, 128 aa, Artificial Sequence
  Description of Artificial Sequence: Synthetic polypeptide
EVQLVESGGGLVQAGGSLRLSCAASGRTFSRYIMGWFRQAPGKEREFVGAISRSGDITSFADFVKGRFTMSRDNAKNTLYLQMNSLEPEDTAVYSCAANSDTYYIYSDIVVPERYDYWGQGTQVTVSS

SEQ ID NO: 6128 - protein, 121 aa, Artificial Sequence
  Description of Artificial Sequence: Synthetic polypeptide
EVQLVESGGGLVQAGDSLRLSCAASGRSFSSRAMGWFRQAPGKEREFVAAINWIGNIPYYANSVKGRFTISRDNAKNTVYLQMNSLKPDDTAVYYCATGSEPYYTNTYDYWGQGTQVTVSS

SEQ ID NO: 6129 - protein, 127 aa, Artificial Sequence
  Description of Artificial Sequence: Synthetic polypeptide
EVQLVESGGGLVQAGGSLRLSCGSSGRTFSRYAMGWFRQAPGKEREFVAAISWSGGSTYYADSVKGRFTISRDNAKNTVYLQMNSLKPEDTAVYYCAADISSGNSGSYIYTWAYDYWGQGTQVTVSS

SEQ ID NO: 6130 - protein, 127 aa, Artificial Sequence
  Description of Artificial Sequence: Synthetic polypeptide
EVQLVESGGGLVQAGDSLRLSCAASGRTFSSYAMGWFRQAPGKEREFVAAISWSDGSTYYADSVKGRFTISRDNAKNTVYLQMNSLKPEDTAVYYCAADLTSTNPGSYIYIWAYDYWGQGTQVTVSS

SEQ ID NO: 6131 - protein, 127 aa, Artificial Sequence
  Description of Artificial Sequence: Synthetic polypeptide
EVQLVESGGGLVQAGGSLRLSCGSSGRTFSRYAMGWFRQAPGKEREFVAAISWSGGSTYYADSVKGRFTISRDNAKNTVYLQMSSLKPEDTAVYYCAADISSGNSGSYIYTWAYDYWGQGTQVTVSS

SEQ ID NO: 6132 - protein, 127 aa, Artificial Sequence
  Description of Artificial Sequence: Synthetic polypeptide
EVQLVESRGGLVQAGGSLRLSCGSSGRTFSRYAMGWFRQAPGKEREFVAAISWSGGSTYYADSVKGRFTISRDNAKNTVYLQMNSLKPEDTAVYYCAADISSGNSGSYIYTWAYDYWGQGTQVTVSS

SEQ ID NO: 6133 - protein, 127 aa, Artificial Sequence
  Description of Artificial Sequence: Synthetic polypeptide
EVQLVESGGGLVQAGGSLRLSCGSSGRTFSRYAMGWFRQAPGKEHEFVAAISWSGGSTYYADSVKGRFTISRDNAKNTVYLQMNSLKPEDTAVYYCAADISSGNSGSYIYTWAYDYWGQGTQVTVSS

SEQ ID NO: 6134 - protein, 121 aa, Artificial Sequence
  Description of Artificial Sequence: Synthetic polypeptide
EVQLVESGGGWVQAGGSLRLSCAASGRAFSSYAMGWIRQAPGKEREFVAGIDQSGESTAYGTSASGRFIISRDNAKNTVYLLMNSLQSDDTAVYYCVADGVLATTLNWDYWGQGTQVTVSS

SEQ ID NO: 6135 - protein, 121 aa, Artificial Sequence
  Description of Artificial Sequence: Synthetic polypeptide
EVQLVESGGGWVQAGGSLRLSCAASGRAFSSYAMGWIRQAPGKEREFVAGIDQSGESTAYGASASGRFIISRDNAKNTVHLLMNSLQSDDTAVYYCVADGVLATTLNWDYWGQGTQVTVSS

SEQ ID NO: 6136 - protein, 124 aa, Artificial Sequence
  Description of Artificial Sequence: Synthetic polypeptide
EVQLVESGGGLVQAGGSLRLSCAASGRTFSSYTMGWFRQAPGKEREFVAAIHWSGSNIYYGNSMKGRLTVSRDNAKNTAYLQMNSLKPEDTAVYYCAAALLGENLQWKGAYDYWGQGTQVTVSS

SEQ ID NO: 6137 - protein, 126 aa, Artificial Sequence
  Description of Artificial Sequence: Synthetic polypeptide
EVQLVESGGGLVQAGGSLRLSCVASGLTFEHYYMGWYRQAPKKEREFVADISRAGASRYADSVKGRFTISRDNAKNTVYLQMNSLESEDTAVYYCAADYSHTFVYPSMVPYESDYWGQGTQVTVSS

SEQ ID NO: 6138 - protein, 124 aa, Artificial Sequence
  Description of Artificial Sequence: Synthetic polypeptide
EVQLVESGGGLVQPGGSLRLSCSASGFTFSVYAMNWVRQAPGKGLEWVSGISFSGGATMYADSVKGRFTISRDNAKNTLYLQMNSLKPEDTGVYYCAKGMSPNIEYAQGPVAYRGQGTQVTVSS

SEQ ID NO: 6139 - protein, 128 aa, Artificial Sequence
  Description of Artificial Sequence: Synthetic polypeptide
EVQLVESGGGLVQAGGSLRLSCVASGRSFSNYPMGWFRQAPGKEREFVGAISGSGSNLYYPGSWKGRFTISRDNAKNTGYLQMNSLKPEDTAVYYCALDHKASGSYSSLSRPEEYDYWGQGTQVTVSS

SEQ ID NO: 6140 - protein, 128 aa, Artificial Sequence
  Description of Artificial Sequence: Synthetic polypeptide
EVQLVESGGGLVQAGGSLRLSCAASGLTLDDYAIGWFRQGPGKAREGVSCISSSDGSTYYADSVKGRFTMFSDNAKNTVALQMNSLKPEDTAVYYCTVLFGTSSCTYYSRRKYEYDYWGQGTQVTVSS

SEQ ID NO: 6141 - protein, 123 aa, Artificial Sequence
  Description of Artificial Sequence: Synthetic polypeptide
EVQLMESGGGLVQAGGSLRLSCAASGGTFSSYAMGWFRQAPGEERDFVAAIGWSGNSPYYAQFVKGRFTISRDNAKNTVHLQMNSLKPEDTAVYYCAAAHNTMGSDYEGYDYWGQGTQVTVSS

SEQ ID NO: 6142 - protein, 130 aa, Artificial Sequence
  Description of Artificial Sequence: Synthetic polypeptide
EVQLVESGGGLVQAGGSLRLSCAASGFTFDDYAIGWFRQAPGKEREGVSCISNSDGSTYYADSVKGRFTISSDNAKNTVYLQMNSLKPEDTAVYYCAASRRGGSRWYGLSGSCYYGMDYWGKGTLVTVSS

SEQ ID NO: 6143 - protein, 124 aa, Artificial Sequence
  Description of Artificial Sequence: Synthetic polypeptide
EVQLVESGGGLVQPGGSLRLSCAASGFTFGNYAMYWVRQAPGKGLEWVSAINSGGGSTGYTDSVKGRFTISRDNAKNTLYLQMNSLKPEDTAVYYCAKDPYGSSWYGSPVYDYWGQGTQVTVSS

SEQ ID NO: 6144 - protein, 128 aa, Artificial Sequence
  Description of Artificial Sequence: Synthetic polypeptide
EVQLVESGGGLVQAGGSLRLSCAASGFAVDDYAIGWFRQAPGKEREGVSSISSSDGSPYYADSVKGRFTISSDNAKNTVYLQMNSLKPEDTAVYYCAAGRSLYAKGSWWLISSEYDYWGQGTQVTVSS

SEQ ID NO: 6145 - protein, 118 aa, Artificial Sequence
  Description of Artificial Sequence: Synthetic polypeptide
EVQLVESGGGLVQPGGSLRLSCAASGSDFGISVMGWYRQAPEKRRELVATITTFGITNYADSVKGRFTVSRDNAQNTVYLQMNSLKPDDTAVYYCYVRWYSSMWYEYWGQGTQVTVSS

SEQ ID NO: 6146 - protein, 127 aa, Artificial Sequence
  Description of Artificial Sequence: Synthetic polypeptide
EVQLVESGGGLVQAGGSLRLSCAASGRTVSSSTMGWFRRAPGKEREFVAAISWNGGTHYADYFVKGRFTLSRDNAKNTVYLQMNSLKPEDTAVYYCAAPISSYVGGNYYSAAFYHYWGQGTQVTVSS

SEQ ID NO: 6147 - protein, 126 aa, Artificial Sequence
  Description of Artificial Sequence: Synthetic polypeptide
EVQLVESGGGLVQAGGSLRLSCAASGRSFSNYVLGWFRQAPGKEREFVAAISFRGDSAIGAPSVEGRFTISRDNAKNTGYLQMNSLVPDDTAVYYCGAGTPLNPGAYIYDWSYDYWGRGTQVTVSS

SEQ ID NO: 6148 - protein, 126 aa, Artificial Sequence
  Description of Artificial Sequence: Synthetic polypeptide
EVQLVESGGGLVQAGGSLSISCAASGGSLSNYVLGWFRQAPGKEREFVAAINWRGDITIGPPNVEGRFTISKDNAKNTGYLQMNSLAPDDTAVYYCGADTPLNPGAYIYDWSYDYWGRGTQVTVSS

SEQ ID NO: 6149 - protein, 131 aa, Artificial Sequence
  Description of Artificial Sequence: Synthetic polypeptide
EVQLAESGGGLVQPGGSLRLSCAASGFTFEYYAMGWFRQAPGKEREGVSCISSSDGSTYYADSVKGRFTISRDNAKNTVYLQMNSLKPEDTAVYYCAADHSRVYYRDYRQGRLCEEPYDYWGQGTQVTVSS

SEQ ID NO: 6150 - protein, 128 aa, Artificial Sequence
  Description of Artificial Sequence: Synthetic polypeptide
EVQLVESGGGLVQAGGSLRLSCTASARRFSTSTMGWFRQAPGNEREFVACISWSGDITFYADSVKGRFTISRDNAKNAVYLQMNSLKPEDSAVYYCAFDARPAPYITNYKDPRAYDYWGQGTQVTVSS

SEQ ID NO: 6151 - protein, 128 aa, Artificial Sequence
  Description of Artificial Sequence: Synthetic polypeptide
EVQLVESGGGLVQAGASLRLSCAASGRMFSSYGMGWFRQAPGKEREFVAAITWSGGYTYYLDSVKGRFTVSRDNAKNMVYLQMNSLKPEDTAVYYCAAGFQYYSTITNYARERDYDYWGQGTQVTVSS

SEQ ID NO: 6152 - protein, 123 aa, Artificial Sequence
  Description of Artificial Sequence: Synthetic polypeptide
EVQLVESGGGLVQPGGSLRLSCVASGLTFSRYDMGWFRQAPGEERKFVAGINWSGGRTYYADSVKGRFTISRDNAKETVSLQMSGLKPEDTAVYYCAADQPPSTWLVEYFDYWGQGTRVTVSS

SEQ ID NO: 6153 - protein, 123 aa, Artificial Sequence
  Description of Artificial Sequence: Synthetic polypeptide
EVQLVESGGGLVQAGGSLRLSCAASGLTFSRYDMGWFRQAPGEERQFVAGINWSGGRTYYADSVKGRFTISRDNAKEIVSLQMSGLKPEDTAVYYCAADQPPSTWLAEYFDYWGQGTRVTVSS

SEQ ID NO: 6154 - protein, 123 aa, Artificial Sequence
  Description of Artificial Sequence: Synthetic polypeptide
EVQLVESGGGLVQAGGSLRLSCAASGLTFSRYDMGWFRQAPGEERKFVAGINWSGGRTYYADSVKGRFTISRDNAKETVSLQMSGLKPEDTAVYYCAADQPPSTWLVEYFDYWGQGTRVTVSS

SEQ ID NO: 6155 - protein, 123 aa, Artificial Sequence
  Description of Artificial Sequence: Synthetic polypeptide
EVQLVESGGGLVQPGGSLRLSCAASGLTFSRYDMGWFRQAPGKEREFVAGINWSGGRTYYADSVKGRFTISRDNAKETVSLQMNGLKPEDTAVYYCAADQPPSTWLVEYFDYWGQGTQVTVSS

SEQ ID NO: 6156 - protein, 127 aa, Artificial Sequence
  Description of Artificial Sequence: Synthetic polypeptide
EVQLVESGGGLVQPGGSLRLSCAASGRTFSSIAMGWFRQAPGKEREFVAAISWSRGRTFYADSVKGRFIISRDDAANTAYLQMNSLKPEDTAVYYCAVDTASWNSGSFIYDWAYDHWGQGTQVTVSS

SEQ ID NO: 6157 - protein, 126 aa, Artificial Sequence
  Description of Artificial Sequence: Synthetic polypeptide
EVQLVESGGGLVQAGGSLKLSCAASGRAFSSYTMGWFRQAPGKEREFVACVSRDGGTTYYAYSVKGRFTISRDNAKNTVYLQMNSLGPEDTAIYTCAAKENGMFITATQEQSYDYWGQGTQVTVSS

SEQ ID NO: 6158 - protein, 126 aa, Artificial Sequence
  Description of Artificial Sequence: Synthetic polypeptide
EVQLVESGGGLVQAGGSLRLSCAASGRTFSSSFMAWFRQVLGSDREFVGGISPGGRFTYYADSRKGRFTISEDNANNTVYLQMHSVKPEDTATYYCAADTQFSGYVPKETNEYDYWGQGTQVTVSS

SEQ ID NO: 6159 - protein, 123 aa, Artificial Sequence
  Description of Artificial Sequence: Synthetic polypeptide
EVQLVESGGGLVQPGGSLRLSCAASGFTFRNYAIGWFRQVPGKEREGVSCINSGGGRIDYADSVKGRFAISRDNAKSTVYLQMNSLKPEDTAVYYCAIDYTSSCPIYSGTDYWGKGTLVTVSS

SEQ ID NO: 6160 - protein, 129 aa, Artificial Sequence
  Description of Artificial Sequence: Synthetic polypeptide
EVQLVESGGGLVQAGGSLRLSCAASGFTFDDYAIGWFRQAPGKEREGVSCIRCNDGSTYYADSVKGRFTISSDNAKNTVYLQMNSLKPEDTAVYYCAADFSLAQYKTIHTMPPYAMDYWGKGTLVTVSS

SEQ ID NO: 6161 - protein, 127 aa, Artificial Sequence
  Description of Artificial Sequence: Synthetic polypeptide
EVQLVESGGGLVQAGGSLRLSCAASGPTFSSYTMGWFRQAPGKEREFVATIPWSGGIPYYSDSVKGRFTMSSDNAKNTVDLQMNSLKPEDTALYYCAGSSRIYVYSDSLSEGSYDYWGRGTQVTVSS

SEQ ID NO: 6162 - protein, 126 aa, Artificial Sequence
  Description of Artificial Sequence: Synthetic polypeptide
EVQLVESGGGLVQAGGSLRLSCVASGRTFNNLAMGWFRQARGKEREFVATISWSHPNTYYTDSVKGRFTISRDDAQNAVYLQMNSLKPEDTAVYYCAANPSYVYSDYLSLAGYTYWGQGTQVTVSS

SEQ ID NO: 6163 - protein, 127 aa, Artificial Sequence
  Description of Artificial Sequence: Synthetic polypeptide
EVQLVESGGGLVQPGGSLRLSCEASGFTFSSYWMYWVRQVPGKGLEWVSAISTGGGDTHYQDSVKGRFTISRDNAKNTLYLQMSSLKPEDTALYYCARNRDSGTSYITFSLTDFASWGQGTQVTVSS

SEQ ID NO: 6164 - protein, 125 aa, Artificial Sequence
  Description of Artificial Sequence: Synthetic polypeptide
EVQLVESGGGLVQAGDSLRLSCAASGLTFSTYVMAWFRQAPGKERECVAAINWSGENIYYADSVKGRFTISRDNAKNTVYLQMNSLKPEDTADYLCAARKYYIHSDVVGNDYPYWGQGTQVTVSS

SEQ ID NO: 6165 - protein, 129 aa, Artificial Sequence
  Description of Artificial Sequence: Synthetic polypeptide
EVQLVESGGGLVQAGGSLRLSCAASERTFSYYAMGWFRQAPGKEREFVATISRSGEWIYYKDAMKGRFTISRDNANNAVYLQMNSLQPEDTAIYYCAADSLGGFRSASDYYNTNTYAYWGQGTQVTVSS

SEQ ID NO: 6166 - protein, 126 aa, Artificial Sequence
  Description of Artificial Sequence: Synthetic polypeptide
EVQLVESGGGLVQPGGSLRLSCAASGFTLDYYAIGWFRQAPGKEREGVSCFPSRYSSDGSTYYADSVKGRFTISRDNAKNTVYLQMNSLKPEDAAVYYCAADPSDWTCNVLEYDYWGQGTQVTVSS

SEQ ID NO: 6167 - protein, 114 aa, Artificial Sequence
  Description of Artificial Sequence: Synthetic polypeptide
EVQLVESGGGLVQPGGSLKLSCAGSGSIFRFYDTAGWYRQAPGKQRELVALITDISGGYIKYADSVKGRFTISRDNAKNTVYLQMNSLKPEDTAVYYCNVHNYWGQGTQVTVSS

SEQ ID NO: 6168 - protein, 127 aa, Artificial Sequence
  Description of Artificial Sequence: Synthetic polypeptide
EVQLVESGGGLVQAGGSPRLSCAASGGTFSSYGMGWFRQAPGKEREFVAAISWSDSSTYYADSVKGRFTISRDNAKNTMYLQMNSLKPEDTAVYYCAAGSGILNSGSYYYPWVYEYWGQGTQVTVSS

SEQ ID NO: 6169 - protein, 125 aa, Artificial Sequence
  Description of Artificial Sequence: Synthetic polypeptide
EVQLVESGGGLVQAGGSLRLSCASSGSIYSINFMNWYRQAPGKQRELVASITSGGYTNYADSVKGRFTISRDNAKNTVYLQMNSLKPEDTAVYICNAEGLIIATMDGGVNNDMDYWGKGTLVTVS

SEQ ID NO: 6170 - protein, 115 aa, Artificial Sequence
  Description of Artificial Sequence: Synthetic polypeptide
EVQLVESGGGLVQPGGSLRLSCAASGNIFSIATMAWYRQAPGKQRELVASISSSGYRIYADSVKGRFTSSRDNAKNTAYLQMNSLGPEDTAVYYCNFRDYEGNHWGQGTQVTVSS

SEQ ID NO: 6171 - protein, 123 aa, Artificial Sequence
  Description of Artificial Sequence: Synthetic polypeptide
EVQLVESGGGLVQAGDSLRLSCAASGLTFSGYEMGWFRQAPGRERAFVAAISQSGGTTSYAVSVKGRFTIARDNAKNTVYLQANNMKPEDTAVYYCAAALLLLPTTPSRVDYWGQGTQVTVSS

SEQ ID NO: 6172 - protein, 123 aa, Artificial Sequence
  Description of Artificial Sequence: Synthetic polypeptide
EVQLVESGGGLVQVGDSLRLSCAASGLTFSGYEMGWFRQAPGKERAFVAAISQSGGTTSYAVSVKGRFTIARDNAKNTVYLQANNMKPEDTAVYYCAAALLLLPTTPSRVDYWGQGTQVTVSS

SEQ ID NO: 6173 - protein, 123 aa, Artificial Sequence
  Description of Artificial Sequence: Synthetic polypeptide
EVQLVESGGGLVQAGDSLRLSCAASGLTFSGYEMGWFRQAPGKERAFVAAISQSGGTTSYAVSVKGRFTITRDNAKNTVYLQANNMKPEDTAVYYCAAALLLLPTTPSRVDYWGQGTQVTVSS

SEQ ID NO: 6174 - protein, 123 aa, Artificial Sequence
  Description of Artificial Sequence: Synthetic polypeptide
EVQLVESGGGLVQAGDSLRLSCAASGLTFSGYEMGWFRQAPGKERAFVAAISQSGGTTSYAVSVKGRFTIARDNAKNTVYLQADNMKPEDTAVYYCAAALLLLPTSPSRVDYWGQGTQVTVSS

SEQ ID NO: 6175 - protein, 123 aa, Artificial Sequence
  Description of Artificial Sequence: Synthetic polypeptide
EVQLVESGGGLVQAGDSLRLSCAASGLTFSGYEMGWFRQAPGKERAFVAAISQSGGTTSYAVSVKGRFTIARDNAKNTVYLQANNMKPEDTAVYYCAAALLLLPTTPSRVDYWGQGTQVTVSS

SEQ ID NO: 6176 - protein, 126 aa, Artificial Sequence
  Description of Artificial Sequence: Synthetic polypeptide
EVQLVESGGGLVQPGGSLRLSCAASGFAFSTYAMGWVRQAPGKGLEWVSCISNGGLRTMYADSVKGRFTISRDNAKNTLYLQMNSLKAEDTAVYYCAKYWAPWPMDVSRLDDYDNKGQGTQVTVSS

SEQ ID NO: 6177 - protein, 128 aa, Artificial Sequence
  Description of Artificial Sequence: Synthetic polypeptide
EVQLVESGGGLVQAGGSLRLSCEASGRTFSSNAMGWFRQAPGKEREFVAAVTRWSGARTVYADSVKGRFTISRDNAENTVYLQMNSLKPEDTAVYTCAADSTNRNSGAIYYPWAYDYWGQGTQVTVSS

SEQ ID NO: 6178 - protein, 128 aa, Artificial Sequence
  Description of Artificial Sequence: Synthetic polypeptide
EVQLVESGGGLVQAGGSLRLSCEASGRTFSSYDMGWFRQAPGKEREFVAAVTRWSGARGVYADSVKGRFTISRDNAENTVHLQMNSLKPEDTAVYTCAADSTNRNSGAVYYTWAYDYWGQGTQVTVSS

SEQ ID NO: 6179 - protein, 128 aa, Artificial Sequence
  Description of Artificial Sequence: Synthetic polypeptide
EVQLVESGGGLVQAGGSLRLSCEASGRTFSNYAMGWFRQAPGKEREFVAVVSRWSGGRTLYADSVKGRFTISRDNAENLVYLQMNSLKPEDTAVYTCVADSTNRNSGAYYYTWAYDHWGQGTQVTVSS

SEQ ID NO: 6180 - protein, 127 aa, Artificial Sequence
  Description of Artificial Sequence: Synthetic polypeptide
EVQLVESGGGLVQAGGSLRLSCAASGRTFSSYAMGWFRQAPGKEREFVAAIWWSGGSTYYADSVKGRFTMSRDNAKNTVYLEMNNLKPEDTAVYYCAADTDSSNSGSYLYTWAYDYWGQGTQVTVSS

SEQ ID NO: 6181 - protein, 127 aa, Artificial Sequence
  Description of Artificial Sequence: Synthetic polypeptide
EVQLVESGGGLVQAGGSLRLSCAASGRTFSPYAMGWFRQAPGKEREFVAAISWSGGTTYYADSVKGRFTISRDNAKNTVYLQMNSLKPEDTAVYNCAADVSSTNSGSYIYTWAYDYWGQGTQVTVSS

SEQ ID NO: 6182 - protein, 127 aa, Artificial Sequence
  Description of Artificial Sequence: Synthetic polypeptide
EVQLVESGGGLVQAGGSLRLSCTASGRTFSSYAMGWFRQAPGKERDFVAAISWSGGSTYYADSVKGRFTISRDNAKNTVYLKMNSLKPEDTAVYYCAVDASSTNSGSFIYTWAYDYWGQGTQVTVSS

SEQ ID NO: 6183 - protein, 128 aa, Artificial Sequence
  Description of Artificial Sequence: Synthetic polypeptide
KVQLVESGGGLVQAGGSLRLSCEASGGSFSSYAMGWFRQAPGKEREFVAAISGWIGPRPVYADSVKGRFTISRDNAENTVYLQMNSLQPEDTAVYTCAADATNRNSGAYFYTWAYDYWGQGTQVTVSS

SEQ ID NO: 6184 - protein, 120 aa, Artificial Sequence
  Description of Artificial Sequence: Synthetic polypeptide
EVQLVESGGDLVQPGGSLRLSCAASGFTFRGYWMTWVRQAPGKGLEWVSSINNVGEETYYVDSVKGRFTISRDNAKNTLYLQMNSLKSEDTAVYYCVKDWESSYAGYSPNSQGTQVTVSS

SEQ ID NO: 6185 - protein, 120 aa, Artificial Sequence; identical to SEQ ID NO: 5904
  Description of Artificial Sequence: Synthetic polypeptide

SEQ ID NO: 6186 - protein, 120 aa, Artificial Sequence
  Description of Artificial Sequence: Synthetic polypeptide
EVQLVESGGDLVQPGGSLRLSCAASGFTFSGYWMTWVRQAPGKGLEWVTSINNIGEETYYVDSVKGRFTISRDNAKNTLYLQMNSLKSEDTAVYYCVKDWASTYAGYRPNSQGTQVTVSS

SEQ ID NO: 6187 - protein, 124 aa, Artificial Sequence
  Description of Artificial Sequence: Synthetic polypeptide
EVQLVESGGGVVQAGGSLRLSCAASGLTFDIYSMGWFRQQPGKEREFVASIGRSGNSTNYASSVKDRFTISRDNAKKLVYLEMNSLTVEDAAVYVCAAKDGPLITHYSTTSMYWGQGTQVTVSS

SEQ ID NO: 6188 - protein, 120 aa, Artificial Sequence; identical to SEQ ID NO: 5906
  Description of Artificial Sequence: Synthetic polypeptide

SEQ ID NO: 6189 - protein, 127 aa, Artificial Sequence
  Description of Artificial Sequence: Synthetic polypeptide
EVQLMESGGGLVQAGGSLRLSCVAPGRIFSSYTMGWFRQAPGKERDFVAAISTVGSTYYSDSVKGRCTISRDNANNTVALELNSLKPDDTAVYYCAABSHTYGSTYAATIDYEYDYWGQGTQVTVSS

SEQ ID NO: 6190 - protein, 124 aa, Artificial Sequence
  Description of Artificial Sequence: Synthetic polypeptide
EVQLVESGGGLVQAGDSLTLSCIDSGRTFSDYPIGWFRQAPGKEREFVAAIYAIGGDVYYADSVKGRFTISRDNAKNTVYLQMSSLKPEDTAIYSCAVASGGGSIRSARRYDYWGQGTQVTVSS

SEQ ID NO: 6191 - protein, 129 aa, Artificial Sequence
  Description of Artificial Sequence: Synthetic polypeptide
EVQLVESGGGLVQAGDSLRLSCIDSGRTFSDYPIGWFRQAPGKEREFVAAIYPTDDNPTGPNAYYADSVKGRFTISRDNAKNTVYLQMSSLKPEDTAIYSCAVASGGGSIISARRYDYWGQGTQVTVSS

SEQ ID NO: 6192 - protein, 121 aa, Artificial Sequence; identical to SEQ ID NO: 5102
  Description of Artificial Sequence: Synthetic polypeptide

SEQ ID NO: 6193 - protein, 115 aa, Artificial Sequence; identical to SEQ ID NO: 5916
  Description of Artificial Sequence: Synthetic polypeptide

SEQ ID NO: 6194 - protein, 126 aa, Artificial Sequence
  Description of Artificial Sequence: Synthetic polypeptide
EVQLVESGGGWVQAGDSLRLSCAASGRTLSSYAMAWFRQAPGKERDFVTGITWNGGSTYYADSVKGRFTISRDNAKNTVYLQMNSLKPEDTAVYYCAABQNTYGYMDRSDYEYDYWGQGTQVTVSS

SEQ ID NO: 6195 - protein, 120 aa, Artificial Sequence
  Description of Artificial Sequence: Synthetic polypeptide
EVQLVESGGDLVQPGGSLRLSCAASGFTFRGYWMTWVRQAPGKGLEWVSSINNIGDEPYYVDSVKGRFTISRDNAKNTLYLQMNSLKSEDTAVYYCVKDWASDYAGYSPNSQGTQVTVSS

SEQ ID NO: 6196 - protein, 119 aa, Artificial Sequence
  Description of Artificial Sequence: Synthetic polypeptide
EVQLVESGGGLVQPGGSLRLSCTASGFTFSSYWMDWVRQTPGKGLEYVSGISPSGGNTDYADSVKGRFTISRDNAKNTLYLQMNSLKPEDTALYYCRRSLTFTDTPDLRSQGTQVTVSS

SEQ ID NO: 6197 - protein, 126 aa, Artificial Sequence
  Description of Artificial Sequence: Synthetic polypeptide
EVQLVESGGGWVQAGDSLRLSCAASGRTLSSYAMAWFRQAPGKERDFVTGITWNGGSTYYADSVKGRFTISRDNAKNTVYLQMNSLKPEDTAVYYCAADQNTYGYMDRSDYEYDYWGQGTQVTVSS

SEQ ID NO: 6198 - protein, 119 aa, Artificial Sequence; identical to SEQ ID NO: 5103
  Description of Artificial Sequence: Synthetic polypeptide

SEQ ID NO: 6199 - protein, 124 aa, Artificial Sequence; identical to SEQ ID NO: 5902
  Description of Artificial Sequence: Synthetic polypeptide

SEQ ID NO: 6200 - protein, 113 aa, Artificial Sequence
  Description of Artificial Sequence: Synthetic polypeptide
EVQLVESGGGLVQAGGSLRLSCAASVSAFSEYAMGWYRQAPGKQREFVATINSLGGTSYADSVKGRFTISRDNAKNTVYLQMNSLKPEDTAVYYCTLYRANLWGQGTQVTVSS

SEQ ID NO: 6201 - protein, 119 aa, Artificial Sequence
  Description of Artificial Sequence: Synthetic polypeptide
KVQLVESGGGLVQPGGSLRLSCAASGSIFSINAMGWYRQAPGKQRELVAHIASSGSTIYADSVKGRFTISRDNAKNTVYLQMNSLKPEDTAVYYCNTRGPAAHEVRDYWGQGTQVTVSS

SEQ ID NO: 6202 - protein, 125 aa, Artificial Sequence
  Description of Artificial Sequence: Synthetic polypeptide
EVQLVESGGGLVQAGGSLRLSCAASRSIFSFNTMGWYRQAPGKQRELVADITSGGSTVYADSVKGRFTISRDDKNTVYLQMNSLKPEDTAVYSCNAEGLIIATMNGGVNYGMDYWGKGTLVTVSS

SEQ ID NO: 6203 - protein, 119 aa, Artificial Sequence
  Description of Artificial Sequence: Synthetic polypeptide
EVQLVESGGGLVQPGGSLRLSCAASGSIFSINAMGWHRQALGKQRELVAQSSSGGSTYYADSAKGRFTISRDNAKNMVYLQMNSLKPEDTAVYYCNVRTPEVHTIRDYWGQGTQVTVSS

SEQ ID NO: 6204 - protein, 128 aa, Artificial Sequence; identical to SEQ ID NO: 6178
  Description of Artificial Sequence: Synthetic polypeptide

SEQ ID NO: 6205 - protein, 127 aa, Artificial Sequence
  Description of Artificial Sequence: Synthetic polypeptide
EVQLVESGGGLVQAGGSLRLSCAASGRTFSSFAMGWFRQAPGKEREFVAAISWSGGSTYYADSVKGRFTISGDNAKNTMYLQMNSLKPEDTAVYYCAADSEILNSGAYYYPWAYVYWGQGTQVTVSS

SEQ ID NO: 6206 - protein, 126 aa, Artificial Sequence
  Description of Artificial Sequence: Synthetic polypeptide
EVQLVESGGGSVQAGGSLRLSCAASGGSFNRFGMGWFRRAPGKERDFVAAINLSGDTTYYVDSVQGRFTISRDNANNIMYLQMNLLKPEDTADYYCAADPDPITAWKQSGAGMDYWGKGTQVTVSS

SEQ ID NO: 6207 - protein, 126 aa, Artificial Sequence
  Description of Artificial Sequence: Synthetic polypeptide
EVQLVESGGGLVQAGGSLSISCAASGGSLSNYVLGWFRQAPGKEREFVAAINWRGDITIGPPNVEGRFTISRDNAKNTGYLQMNSLAPDDTAVYYCGAGTPLNPGAYIYDWSYDYWGRGTQVTVSS

SEQ ID NO: 6208 - protein, 128 aa, Artificial Sequence; identical to SEQ ID NO: 6127
  Description of Artificial Sequence: Synthetic polypeptide

SEQ ID NO: 6209 - protein, 128 aa, Artificial Sequence; identical to SEQ ID NO: 6116
  Description of Artificial Sequence: Synthetic polypeptide

SEQ ID NO: 6210 - protein, 115 aa, Artificial Sequence
  Description of Artificial Sequence: Synthetic polypeptide
EVQLVESGGGLVQPGESLRLSCAFSGIVFEFYDMGWYRQAPGMQRELVANIASGGSTNLADAVKGRFTISRDNAQKKIDLQMNSLRREDTAVYYCNARYGSREYWGQGTQVTVSS

SEQ ID NO: 6211 - protein, 115 aa, Artificial Sequence
  Description of Artificial Sequence: Synthetic polypeptide
EVQLVESGGGLVQPGESLRLSCAFSGIVFEFYDMGWYRQAPGKQRELVANIASRGSTDLADSVKGRFTISRDNAQKKIDLQMNGLGREDTAVYYCNAQYGSREYWGQGTQVTVSS

SEQ ID NO: 6212 - protein, 115 aa, Artificial Sequence
  Description of Artificial Sequence: Synthetic polypeptide
EVQLVESGGGLAQAGGSLRLSCAVSGEAVGSSATGWYRAVSATERELVARIRSGGSTDYADSVKGRFTVSRDNAKNTVYLQMNSLKPEDTAVYYCNLVSYGEYFWGKGTLVTVSS

SEQ ID NO: 6213 - protein, 124 aa, Artificial Sequence
  Description of Artificial Sequence: Synthetic polypeptide
EVQLVESGGGLVQAGGSLRLSCAASGRTLSSYRLGWFRQAPGKEREFISTISWNGRSTYYADSVKGRFIFSEDEAKNTVHLQMNSLKPEDTAVYYCAAALIGGYYSDVDAWSYWGPGTQVTVSS

SEQ ID NO: 6214 - protein, 117 aa, Artificial Sequence; identical to SEQ ID NO: 6022
  Description of Artificial Sequence: Synthetic polypeptide

SEQ ID NO: 6215 - protein, 124 aa, Artificial Sequence; identical to SEQ ID NO: 6213
  Description of Artificial Sequence: Synthetic polypeptide

SEQ ID NO: 6216 - protein, 115 aa, Artificial Sequence; identical to SEQ ID NO: 6013
  Description of Artificial Sequence: Synthetic polypeptide

SEQ ID NO: 6217 - protein, 125 aa, Artificial Sequence; identical to SEQ ID NO: 6021
  Description of Artificial Sequence: Synthetic polypeptide

SEQ ID NO: 6218 - protein, 124 aa, Artificial Sequence
  Description of Artificial Sequence: Synthetic polypeptide
EVQLVESGGGLVQAGGSLRLSCAASGRTVSSYYMGWFRQAPGNEREFVAAFSWSSSKPYYADSVKGRFTISRDSAGNTVYLQMNSLKPEDTAVYWCGARQIGTYYSDYENYDYWGQGTQVTVSS

SEQ ID NO: 6219 - protein, 124 aa, Artificial Sequence
  Description of Artificial Sequence: Synthetic polypeptide
EVQLVESGGGLVQAGGSLRLSCAASGRAFSRYYMGWFRQAPGKEREVVAAFSWSGGMTYYADSVKGRFTMSRDSASDTVYLQMNSLKPEDTAVYYCGARQMGVYYSDYENYDYWGQGTQVTVSS

SEQ ID NO: 6220 - protein, 124 aa, Artificial Sequence
  Description of Artificial Sequence: Synthetic polypeptide
EVQLVESGGGLVQAGGSLRLSCAASGRTVSSYYMGWFRQAPGNEREFVAAFSWSGSKPYYADSVKGRFTISRDSAGNTVYLQMNSLKPEDTAVYWCGARQIGTYYSDYENYDYWGQGTQVTVSS

SEQ ID NO: 6221 - protein, 125 aa, Artificial Sequence
  Description of Artificial Sequence: Synthetic polypeptide
EVQLVESGGGLVQAGGSLRLSCAASGRTLSSYRLSWFRQAPGKEREFVATHSWDGRRTYYADSVKGRFTFSRDNAKNTVYLQLNSLKPEDTAVYHCAAATLIGGYYSDLDNYDYWGPGTQVTVSS

SEQ ID NO: 6222 - protein, 124 aa, Artificial Sequence; identical to SEQ ID NO: 6219
  Description of Artificial Sequence: Synthetic polypeptide

SEQ ID NO: 6223 - protein, 124 aa, Artificial Sequence; identical to SEQ ID NO: 6213
  Description of Artificial Sequence: Synthetic polypeptide

SEQ ID NO: 6224 - protein, 115 aa, Artificial Sequence; identical to SEQ ID NO: 6013
  Description of Artificial Sequence: Synthetic polypeptide

SEQ ID NO: 6225 - protein, 115 aa, Artificial Sequence
  Description of Artificial Sequence: Synthetic polypeptide
EVQLVESGGGLVQAGGSLRLSCAVSGDTFDNSAAGWYRATSETQRELVARIRSSGSTNYADSVKGRFTVSRDNAKNTVYLQMNSLKPEDTAVYYCNVVSYGEYFWGKGTLVTVSS

SEQ ID NO: 6226 - protein, 124 aa, Artificial Sequence
  Description of Artificial Sequence: Synthetic polypeptide
EVQLVESGGGLVQAGGSLRLSCAASGRTFDTYFVGWFRQAPGKERDFVAAISWSGDRTFYADSVKGRFTISRDNAKNTEYLQMNSLKPEDTAVYYCAAREYGRLYSDSEAYDYWGQGTQVTVSS

SEQ ID NO: 6227 - protein, 125 aa, Artificial Sequence; identical to SEQ ID NO: 6021
  Description of Artificial Sequence: Synthetic polypeptide

SEQ ID NO: 6228 - protein, 119 aa, Artificial Sequence
  Description of Artificial Sequence: Synthetic polypeptide
EVQLVESGGGLVQPGGSLRLSCAASGFTFGNYDMSWVRQAPGKGPEWVSGINTGGSTLYADSVKGRFTISRDNAKNTLYLQMNSLKSEDTAVYYCAKDLYGSTWYTDYWSQGTQVTVSS

SEQ ID NO: 6229 - protein, 124 aa, Artificial Sequence
  Description of Artificial Sequence: Synthetic polypeptide
EMQLVESGGGLVQAGDSLRLSCAASGDTFSWYVMAWFRQAPGKEREFVTWINRSGASTYYADSVKGRFTIFRDNDKNTVYLQMNSLKPEDTAVYYCAAGGFYGLRTTEERYDTWGQGTQVTVSS

SEQ ID NO: 6230 - protein, 120 aa, Artificial Sequence
  Description of Artificial Sequence: Synthetic polypeptide
EVQLVESGGGLVQPGGSLRLSCAASGFTFGSSDMSWVRQAPGKGPEWVSGINSGGGRTLYADSVKGRFTISRDNAKNTLYLQMNSLKSEDTAVYYCATDLYGSSWYTDYWSQGTQVTVSS

SEQ ID NO: 6231 - protein, 125 aa, Artificial Sequence; identical to SEQ ID NO: 6021
  Description of Artificial Sequence: Synthetic polypeptide

SEQ ID NO: 6232 - protein, 125 aa, Artificial Sequence; identical to SEQ ID NO: 6021
  Description of Artificial Sequence: Synthetic polypeptide

SEQ ID NO: 6233 - protein, 117 aa, Artificial Sequence
  Description of Artificial Sequence: Synthetic polypeptide
EVQLVESGGGLVQPGGSLRLSCAASGFTFGSSDMSWVRQAPGKGPEWVSGINSGGGITDYANSVKGRFTISRDNAKNTLYLQMNSLKPEDTAVYSCATDFWGSTWSGLPGTQVTVSS

SEQ ID NO: 6234 - protein, 117 aa, Artificial Sequence; identical to SEQ ID NO: 6022
  Description of Artificial Sequence: Synthetic polypeptide

SEQ ID NO: 6235 - protein, 125 aa, Artificial Sequence
  Description of Artificial Sequence: Synthetic polypeptide
EVQLVESGGGLVQAGGSLRLSCAASGGTFSPYVMAWFRQAPGNEREFVARIRWSSINTAYDDSVKGRFTISRDNAKSTVYLQMDSLKPEDTAVYYCAAATYGYGSYTYQGSYDHWGQGTQVTVSS

SEQ ID NO: 6236 - protein, 119 aa, Artificial Sequence
  Description of Artificial Sequence: Synthetic polypeptide
EVQLVESGGGLVQPGGSLRLSCEASGFTFGSRDMHWVRQAPGKGGPEWVSGINSGASNTHYADSVKGRFTISRDNAKNTLYLQMNSLKAEDTAVYYCATEFWPGVYDTSTPGTQVTVSS

SEQ ID NO: 6237 - protein, 125 aa, Artificial Sequence; identical to SEQ ID NO: 6021
  Description of Artificial Sequence: Synthetic polypeptide

SEQ ID NO: 6238 - protein, 115 aa, Artificial Sequence; identical to SEQ ID NO: 6212
  Description of Artificial Sequence: Synthetic polypeptide

SEQ ID NO: 6239 - protein, 119 aa, Artificial Sequence
  Description of Artificial Sequence: Synthetic polypeptide
EVQLVESGGGLVQPGGSLRLSCAASGFTFGSYDMSWVRQAPGKGSEWVSHINTGGGSTTYADSVKGRFTISRDNAKNTLYLQMSSLKPEDTAVYYCATGLYGGSTDDYWGQGTQVTVSS

SEQ ID NO: 6240 - protein, 117 aa, Artificial Sequence; identical to SEQ ID NO: 6022
  Description of Artificial Sequence: Synthetic polypeptide

SEQ ID NO: 6241 - protein, 125 aa, Artificial Sequence; identical to SEQ ID NO: 6021
  Description of Artificial Sequence: Synthetic polypeptide

SEQ ID NO: 6242 - protein, 119 aa, Artificial Sequence
  Description of Artificial Sequence: Synthetic polypeptide
EVQLVESGGGLVQPGGSLRLSCAASGFTFGSHDMSWVRQAPGKGSEWVSGIKSGGGSTLYADSVKGRFAISRDNAKNTLYLQMNSLKPEDTAVYYCATDLYGSTWYPGEDRGTQVTVSS

SEQ ID NO: 6243 - protein, 125 aa, Artificial Sequence; identical to SEQ ID NO: 6021
  Description of Artificial Sequence: Synthetic polypeptide

SEQ ID NO: 6244 - protein, 124 aa, Artificial Sequence; identical to SEQ ID NO: 6226
  Description of Artificial Sequence: Synthetic polypeptide

SEQ ID NO: 6245 - protein, 116 aa, Artificial Sequence
  Description of Artificial Sequence: Synthetic polypeptide
EVQLVESGGGLVQAGGSLRLSCTSSGSIFNFIMGWYRQAPGKQRELVADITRGDERNYLDAVKGRFIITRDSAKNTIYLQMNSLQPADSGVYWCHGLGVVSNREYWGQGTQVTVSS

SEQ ID NO: 6246 - protein, 123 aa, Artificial Sequence
  Description of Artificial Sequence: Synthetic polypeptide
QVQLQESGGGLVQPGGSLRLSCTASRTDISFNPMAWYRQAPGQQRELVASITSGGTTNYANSVKGRFTISRDNPKNTMYLQMNSLKPEDTAVYYCNGRGPRYTTTGWITDDYWGQGTQVTVSS

SEQ ID NO: 6247 - protein, 123 aa, Artificial Sequence
  Description of Artificial Sequence: Synthetic polypeptide
QVQLQQSGGGLVQPGGSLRLSCAASRSDFAFNPMGWYRQAPGKQRELVAVLTTGGTTNYADSVKGRFTISRDNARNTVYLQMNSLKPEDTAVYYCYARGPRKAPTGWITDDYWGQGTQVTVSS

SEQ ID NO: 6248 - protein, 123 aa, Artificial Sequence
  Description of Artificial Sequence: Synthetic polypeptide
QVQLQESGGGLVQPGGSLRLSCAASRSGFSFNPMGWYRQAPGKQRELVATITSGGTTNYADSVKGRFTISTDNAKTTVFLQMNSLKPEDTAVYYCNARGPRRGTAGWITDDYWGQGTQVTVSS

SEQ ID NO: 6249 - protein, 123 aa, Artificial Sequence
  Description of Artificial Sequence: Synthetic polypeptide
QVQLQESGGGLVQPGGSLRLSCAASRTDISFNPMGWYRQAPGKQRELVATMTSGGTTGYADSVKGRFTISRDNPKNTLYLQMNSLEPEDTAVYYCHARGPRYATTGWFTDDYWGQGTQVTVSS

SEQ ID NO: 6250 - protein, 123 aa, Artificial Sequence
  Description of Artificial Sequence: Synthetic polypeptide
QVQLQESGGGLVQPGGSLRLSCAASRSGFVFNPMGWYRQAPGKQRELVAVITASLTTNYADSVKGRFTISRDNTGNTAYLQMNSLKPEDTAVYYCYGRGPRKAPTGWITDDYWGQGTQVTVSS

SEQ ID NO: 6251 - protein, 123 aa, Artificial Sequence
  Description of Artificial Sequence: Synthetic polypeptide
QVQLQQSGGGLVQAGGSLRLSCAASGSGFSFNPMGWYRQAPGKQRELVASITSGGTTNYVDSVKGRFTISRGNAKNTVYLQMNSLKPEDTAVYYCAAEGPRRRGSTWYTDNYWGQGTQVTVSS

SEQ ID NO: 6252 - protein, 123 aa, Artificial Sequence
  Description of Artificial Sequence: Synthetic polypeptide
QVQLQESGGGLVQPGGSLRLSCAASVSGFIFNPMGWYRQARGKQREEVAVLTTGGTTKYADSVKDRFTISRDNARNTVDLQMNSLKPEDTAVYYCYARGPRHVPTGWITDDYWGQGTQVTVSS

SEQ ID NO: 6253 - protein, 123 aa, Artificial Sequence
  Description of Artificial Sequence: Synthetic polypeptide
QVQLQQSGGGLVQPGGSLRLSCAASSSGFSFNPMGWYRQAPGKQRELVATMTSGGTTNYADSVKGRFTISRDNAKTTVYLQMNSLKPEDTAVYYCNARGPRRATTGWITDDYWGQGTQVTVSS

SEQ ID NO: 6254 - protein, 123 aa, Artificial Sequence
  Description of Artificial Sequence: Synthetic polypeptide
QVQLQESGGGLVQAGGSLRLSCAASGSGFSFNPMGWYRQAPGKQRELVASITSGGTTNYVDSVKGRFTISRGNAKNTVYLQMNSLKPEDTAVYYCAAEGPRRRGSTWYTDNYWGQGTQVTVSS

SEQ ID NO: 6255 - protein, 123 aa, Artificial Sequence
  Description of Artificial Sequence: Synthetic polypeptide
QVQLQQSGGGLVQPGGSLRLSCAASRGDISFNPMGWYRQAPGKQRELVATITNGGTTNYADSVKGRFTISRDNAETAVYLQMNSLKPEDTAVYYCNARGPRHATTGWYTDDYWGQGTQVTVSS

SEQ ID NO: 6256 - protein, 123 aa, Artificial Sequence
  Description of Artificial Sequence: Synthetic polypeptide
QVQLQESGGGLVQPGGSLRLSCAASRSGFSFNPMGWYRQAPGKQRELVATITSGGTTNYADSVKGRFTISTDNAKTTVYLQMNSLKPEDTAVYYCNGRGPRRATTGWITDDYWGQGTQVTVSS

SEQ ID NO: 6257 - protein, 123 aa, Artificial Sequence
  Description of Artificial Sequence: Synthetic polypeptide
QVQLQESGGGLVQPGGSLRLSCAASRSDFAFNPMGWYRQAPGKQRELVAVLTTGGTTNYADSVKGRFTISRDNARNTVYLQMNSLKPEDTAVYYCYARGPRKAPTGWITDDYWGQGTQVTVSS

SEQ ID NO: 6258 - protein, 123 aa, Artificial Sequence
  Description of Artificial Sequence: Synthetic polypeptide
QVQLQQSGGGLVQAGGSLRLSCAASGNIISFNPMGWHRQAPGKQRELVASITSGGSISYVDSVKGRFTISRDSAKNTIYLQMNSLKPEDTAVYFCAGEGPRRRGSTWYTDTYWGQGTQVTVSS

SEQ ID NO: 6259 - protein, 123 aa, Artificial Sequence
  Description of Artificial Sequence: Synthetic polypeptide
QVQLQQSGGGLVQPGGSLRLSCAASRSGFSFNPMGWYRQAPGKQRELVATITSGGTTNYADSVKGRFTISTDNAKTTVFLQMNSLKPEDTAVYYCNGRGPRRGTAGWFTDDYWGQGTQVTVSS

SEQ ID NO: 6260 - protein, 123 aa, Artificial Sequence
  Description of Artificial Sequence: Synthetic polypeptide
QVQLQQSGGGLVQPGGSLRLSCAASRSDISFNPMGWYRQAPGKQRELVATISNGGTTNYADSVKGRFTISQDNAKTTVYLQMNSLKPEDTAVYYCNGRGPRYATTGWYTDDYWGQGTQVTVSS

SEQ ID NO: 6261 - protein, 123 aa, Artificial Sequence
  Description of Artificial Sequence: Synthetic polypeptide
QVQLQESGGGLVQPGGSLRLSCAASRSDISFNPMGWYRQAPGKQRELVATISNGGTTNYADSVKGRFTISQDNAKTTVYLQMNSLKPEDTAVYYCNGRGPRYATTGWYTDDYWGQGTQVTVSS

SEQ ID NO: 6262 - protein, 121 aa, Artificial Sequence
  Description of Artificial Sequence: Synthetic polypeptide
QVQLQESGGGLVQPGGSLRLSCAASGSIFSINRMGWYRQAPGKQRELVAAITYGGSTNYADSVKGRFTISRDNAKNTVYLQMNSLKPEDTAVYYCNAGSTYSPFGDKYDYWGQGTQVTVSS

SEQ ID NO: 6263 - protein, 123 aa, Artificial Sequence
  Description of Artificial Sequence: Synthetic polypeptide
QVQLQQSGGGLVQAGGSLRLSCAASGSAFSINTMGWYRQAPGKQRELVAVISSGSGGSTNYADSVKGRFTISRDNAKNTVYLHMNSLKPEDTAVYYCNAGSRFNPFGSAYDYWGQGTQVTVSS

SEQ ID NO: 6264 - protein, 121 aa, Artificial Sequence
  Description of Artificial Sequence: Synthetic polypeptide
QVQLQQSGGGLVQPGGSLRLSCAASGSTFSINAMGWYRQAPGKQRELVAAISSGGSTNYADSVKGRFTISRDNAKNTVYLQMNSLKPEDTAVYYCNAGSRFNPEGSAYDYWGQGTQVTVSS

SEQ ID NO: 6265 - protein, 121 aa, Artificial Sequence
  Description of Artificial Sequence: Synthetic polypeptide
QVQLQQSGGGLVQAGGSLRLSCAASGSSFSINAMGWYRQAPGKQRELVAAISSGGSANYADSVKGRFTISRDNAKNTVYLQMNSLKPEDTAVYYCNAGSRFNPEGSAYDYWGQGTQVTVSS

SEQ ID NO: 6266 - protein, 121 aa, Artificial Sequence
  Description of Artificial Sequence: Synthetic polypeptide
QVQLQESGGGLVQAGGSLRLSCAASGSTFSINAMGWYRQAPGKQRELVAAISSGGSTNYADSVKGRFTISRDNAKNTVYLQMNSLKPEDTAVYYCNAGSRFNPEGSAYDYWGQGTQVTVSS

SEQ ID NO: 6267 - protein, 125 aa, Artificial Sequence
  Description of Artificial Sequence: Synthetic polypeptide
QVQLQESGGGLVQAGDSLRLSCAASGRTFNSLTMAWFRQAPGKDRDFVSVVNWDGDRTNYADSVKGRFTIFRDNAKNTVYLQMNGLKPDDTAIYRCAARWDYGLWRPSTYNYAYWGQGTQVIVSS

SEQ ID NO: 6268 - protein, 128 aa, Artificial Sequence
  Description of Artificial Sequence: Synthetic polypeptide
QVQLQESGGGLVQAGGSLRLSCAFSGDTFSFYTLGWFRQAPGKEREFVAATSNIGGYIYYGDSVKGRFTISGDNAKNTVYLQMSSLKPEDTAVYYCAATLRSGSMWYQNVRVNDNPYWGQGTQVTVSS

SEQ ID NO: 6269 - protein, 124 aa, Artificial Sequence
  Description of Artificial Sequence: Synthetic polypeptide
QVQLQESGGGLVQAGGSLRLSCAASGRPFSSAAMGWFRQAPGKEREFVSAISYTGDVTRYADSVKGRFTISRDNTRNTLTLEMNSLKPEDTAVYYCAARTYAGVRAHTYDYDYWGQGTQVTVSS

SEQ ID NO: 6270 - protein, 122 aa, Artificial Sequence
  Description of Artificial Sequence: Synthetic polypeptide
QVQLQESGGGLVQAGGSLRLSCAASGRSLSRYAMGWFRQAPGKEREFVATKTSGGVTYYGASVKGRFTISRDNAKNMVYLQMNSLNPEDTAIYYCAAGTDAIFKPWMLPDYWGQGTQVTVSG

SEQ ID NO: 6271 - protein, 127 aa, Artificial Sequence
  Description of Artificial Sequence: Synthetic polypeptide
QVQLQESGGGLVETGGSLRLSCAASGRTFGGYALAWFRQAPGKGREFVAAVTWTSGTTNYAGSVKDRFTVSRDNAGNTMYLQMNSLRPEDTAVYICGAASGYRSPDRLSEPNWVNYWGQGTQVTVSS

SEQ ID NO: 6272 - protein, 127 aa, Artificial Sequence
  Description of Artificial Sequence: Synthetic polypeptide
QVQLQESGGGLVQTGGSLRLSCAASGRTFGGYAMAWFRQAPRKGREFVASVTWNGGATDYAGSVKDRFTVSRDTANNTMYLQMNSLKPEDTAVYICGAASGYRSTDRLSDPGWTNYWGQGTQVTVSS

SEQ ID NO: 6273 - protein, 127 aa, Artificial Sequence
  Description of Artificial Sequence: Synthetic polypeptide
QVQLQESGGGLVQTGGSLRLSCAASGRTFGGYAMAWFRQVPGKGREFVAAVTWSSGTTNYARSVKDRFIVSRDNANNTMYLQMNSLKPEDTAVYICGAASGYRSTDRLSEPAWINYWGQGTQVTVSS

SEQ ID NO: 6274 - protein, 127 aa, Artificial Sequence
  Description of Artificial Sequence: Synthetic polypeptide
QVQLQESGGGLVQTGGSLRLSCAASGRTFGGYAMAWFRQAPGKGREFVAAVTWSSGTTNYAGSVKDRFTVSRDNANNTMYLQMNSLKPEDTAVYICGAASGYRSTDRLSTPEWINYWGQGTQVTVSS

SEQ ID NO: 6275 - protein, 127 aa, Artificial Sequence
  Description of Artificial Sequence: Synthetic polypeptide
QVQLQESGGGLVQTGGSLRLSCAASGRTFGGYAMAWFRQAPGKGREFVAAVTWSAGTTNYAGSVKDRFTVSRDNANNTMYLQMNSLKPEDTAVYICGAATGYRSTDRLAEPGWVNYWGQGTQVTVSS

SEQ ID NO: 6276 - protein, 127 aa, Artificial Sequence
  Description of Artificial Sequence: Synthetic polypeptide
QVQLQQSGGGLVQTGGSLRLSCAASGRTFGGYAMAWFRQAPGKGREFVAAVTWSAGTTNYAGSVKDRFTVSRDNANNTMYLQMNSLKPEDTAVYICGAASGYRSTDRLSEPAWINYWGQGTQVTVSS

SEQ ID NO: 6277 - protein, 127 aa, Artificial Sequence
  Description of Artificial Sequence: Synthetic polypeptide
QVQLQESGGGLVQTGGSLRLSCAASGRTFGGYAMAWFRQAPGKGREFVAAVTWSAGTTNYAGSVKDRFTVSRDNANNTMYLQMNSLKPEDTAVYICGAATGYRSTDRLTEPAWVNYWGQGTQVTVSS

SEQ ID NO: 6278 - protein, 127 aa, Artificial Sequence
  Description of Artificial Sequence: Synthetic polypeptide
QVQLQESGGGLVQAGGSLRLSCATSGRPFGGYAMAWFRQAPGKGREFVAAVTWSAGTTNYAGSVKDRFTVSRDNANNTMYLQMNSLKPEDTAVYICGAATGYRSTDRLSDPNWVNYWGQGTQVTVSS

SEQ ID NO: 6279 - protein, 127 aa, Artificial Sequence
  Description of Artificial Sequence: Synthetic polypeptide
QVQLQESGGGLVQAGGSLRLSCAASGRTFGGYAMAWFRQAPGKGREFVAAVTWSSGTTNYAGSVKDRFTVSRDNANNTMYLRMNSLKPEDTAVYICGAASGYRSTDRLSDAAWINYWGQGTQVTVSS

SEQ ID NO: 6280 - protein, 127 aa, Artificial Sequence
  Description of Artificial Sequence: Synthetic polypeptide
QVQLQQSGGGLVQTGGSLRLSCAASGRTFGGYAMAWFREAPGKGREFVAAVTWSSGTTNYAGSVKDRFTVSRDNANNTMYLQMNSLKPEDTAVYICGAASGYRSTDRLSTPEWINYWGQGTQVTVSS

SEQ ID NO: 6281 - protein, 127 aa, Artificial Sequence
  Description of Artificial Sequence: Synthetic polypeptide
QVQLQESGGGLVQTGGSLRLSCAASGRTFGGYAMAWFRQAPGKGREFVAAVTWSSGTTNYAGSVKDRFTVSRDNGNNTMYLQMNSLKPEDTAVYICGVASGYRSTDRLSEPGWINYWGQGTQVTVSS

SEQ ID NO: 6282 - protein, 127 aa, Artificial Sequence
  Description of Artificial Sequence: Synthetic polypeptide
QVQLQESGGGLVQTGGSLRLSCAASGRTFGGYAMAWFRQAPGKGREFVAAITWSAGTTNYADSMKDRFTVSRDTANNTMYLEMNRLKPDDTAVYICGAATGYRSTDRLSTPAWINYWGQGTQVTVSS

SEQ ID NO: 6283 - protein, 127 aa, Artificial Sequence
  Description of Artificial Sequence: Synthetic polypeptide
QVQLQESGGGLVRTGDSLRLSCAASGRTFNGYAMAWFRQAPGKGREFVAAVTWSSGTTNYAGSVKDRFTVSRDNANNTMYLQMNSLKPEDTAVYICGAASGYRSTDRLSDPAWTNYWGQGTQVTVSS

SEQ ID NO: 6284 - protein, 127 aa, Artificial Sequence
  Description of Artificial Sequence: Synthetic polypeptide
QVQLQESGGGLVETGGSLRLSCAASGRTFGGYAMAWFRQAPGKGREFVAAVTWTSGTTNYAGSVKDRFTVSRDNANNTMYLQMNSLKPEDTAVYICGAASGYRSPDRLSEPEWINYWGQGTQVTVSS

SEQ ID NO: 6285 - protein, 127 aa, Artificial Sequence
  Description of Artificial Sequence: Synthetic polypeptide
QVQLQESGGGLVQTGGSLRLSCAASGGTFGGYAMAWFRQAPGKGREFVASVIWNGGTTNYLDSVKDRFTVSRDMANNTMYLQMNSLKPEDTAVYICGAASGYRSTDRLSEPGWVNYWGQGTQVTVSS

SEQ ID NO: 6286 - protein, 127 aa, Artificial Sequence
  Description of Artificial Sequence: Synthetic polypeptide
QVQLQESGGGLVQAGGSLRLSCAASGRTLNNYAMGWFRQAPGAEREFVGAISASGDSTQYTESVQGRFTISKDNAKSTVYLDMNSLKPEDTAVYYCAADRKTLAYYTSRLRSRYDYWGQGTQVTVSS

SEQ ID NO: 6287 - protein, 127 aa, Artificial Sequence
  Description of Artificial Sequence: Synthetic polypeptide
QVQLQQSGGGLVQAGGSLRLSCAASGGTLNNYAMGWFRQAPGAEREFVGAISAGGDSTQYTESVQGRFTISKDNAKSTVYLDMNSLKPEDTAVYYCAADRKTLTYYTSRLRSRYDYWGQGTQVTVSS

SEQ ID NO: 6288 - protein, 127 aa, Artificial Sequence
  Description of Artificial Sequence: Synthetic polypeptide
QVQLQESGGGLVQAGGSLRLSCAASGRTLNNYAMGWFRQAPGAEREFVGAISASGDSTQYTESVQGRFTISKDNAKSTVYLDMNSLKPEDTAVYYCAADRKTLTFYTSRLRSRYDYWGQGTQVTVSS

SEQ ID NO: 6289 - protein, 127 aa, Artificial Sequence
  Description of Artificial Sequence: Synthetic polypeptide
QVQLQQSGGGLVQAGGSLRLSCAASGRTLNNYAMGWFRQAPGAEREFVGAISASGDSTQYTESVQGRFTISKDNAKSTVYLDMNSLKPEDTAVYYCAADRKTLTFYTSRLRSRYDYWGQGTQVTVSS

SEQ ID NO: 6290 - protein, 127 aa, Artificial Sequence
  Description of Artificial Sequence: Synthetic polypeptide
QVQLQESGGGLVQAGGSLRLSCVASGRTLDNYAMGWFRQAPGAEREFVGAISANGEDTQYTESVQGRFTISKDNAKSTVYLDMNSLKPEDTAVYYCAADRKTLTYYTSRLRSRYEYWGQGTQVTVSS

SEQ ID NO: 6291 - protein, 127 aa, Artificial Sequence
  Description of Artificial Sequence: Synthetic polypeptide
QVQLQQSGGGLVQAGGSLRLSCAASGRTLNNYAMGWFRQAPGAEREFVGAISASGDSTQYTESVQGRFTISKDNAKSTVVLDMNSLKPEDTAVYYCAADGKTLTFYTSRLRSRYDYWGQGTQVTVSS

SEQ ID NO: 6292 - protein, 127 aa, Artificial Sequence
  Description of Artificial Sequence: Synthetic polypeptide
QVQLQQSGGGLVQAGGSLRLSCAASGRTLNNYAMGWFRQAPGAEREFVGAISASGDSTQYTESVQGRFSISKDLAKSTVYLDMNSLKPEDTAVYYCAADQKTLTFYTSRLRSRYDYWGQGTQVTVSS

SEQ ID NO: 6293 - protein, 127 aa, Artificial Sequence
  Description of Artificial Sequence: Synthetic polypeptide
QVQLQESGGGLVQAGGSLRLSCAASGRTLNNYAMGWFRQAPGAEREFVGAISASGDSTDYTESVQGRFTISKDNAKSTVYLDMNSLKPEDTAVYYCAADRKTLTFYTSRLRSRYDYWGQGTQVTVSS

SEQ ID NO: 6294 - protein, 127 aa, Artificial Sequence
  Description of Artificial Sequence: Synthetic polypeptide
QVQLQESGGGLVQAGGSLRLSCAASGRTLNNYAMGWFRQAPGAEREFVGAISASGDSTQYTESVQGRFTISKDYAKSTVYLDMNSLKPEDTAVYYCAADQKTLTYYTSRLRSRYDYWGQGTQVTVSS

SEQ ID NO: 6295 - protein, 127 aa, Artificial Sequence
  Description of Artificial Sequence: Synthetic polypeptide
QVQLQESGGGLVQAGGSLRLSCAASGHTLNNYAMGWFRQGPGAEREFVGAISASGDSTQYTESVQGRFTISKDNAKRTVYLDMNSLKPEDTAVYYCAADGKTLTYYTSRLRSQYDYWGQGTQVTVSS

SEQ ID NO: 6296 - protein, 127 aa, Artificial Sequence
  Description of Artificial Sequence: Synthetic polypeptide
QVQLQQSGGGLVQAGESLRLSCAASGRTLNNYAMGWFRQAPGAEREFVGAISASGDSTQYTESVQGRFTISKDNAKSTVYLDMNSLKPEDTAVYYCAADRKTLTFYTSRLRSRYDYWGQGTQVTVSS

SEQ ID NO: 6297 - protein, 123 aa, Artificial Sequence
  Description of Artificial Sequence: Synthetic polypeptide
QVQLQESGGGLVQAGGFLRLSCAASGRSFNTYAMGWFRQAPGKEREFVAGITRSGTATDYADSVKGRFTISRDNARNTVYLQMNRLKSEDSAVYYCAAHASYDRMIYSEYKYWGQGTQVTVSS

SEQ ID NO: 6298 - protein, 123 aa, Artificial Sequence
  Description of Artificial Sequence: Synthetic polypeptide
QVQLQQSGGGLVQAGGFLRLSCAASGRSFNTYAMGWFRQAPGKEREFVAGITRSGTATDYIDSVKGRFTISRDNARDTVYLQMNRLNPEDSAVYYCAAHANYDRMINSEYKYWGQGTQVTVSS

SEQ ID NO: 6299 - protein, 123 aa, Artificial Sequence
  Description of Artificial Sequence: Synthetic polypeptide
QVQLQESGGGLVQAGGFLRLSCAASGRSFNTYAMGWFRQAPGKEREFVAGITRSGTATDYIDSVKGRFTISRDNARDTVYLQMNRLNPEDSAVYYCAAHANYDRMINSEYKYWGQGTQVTVSS

SEQ ID NO: 6300 - protein, 123 aa, Artificial Sequence
  Description of Artificial Sequence: Synthetic polypeptide
QVQLQQSGGGLVQAGGFLRLSCAASGRSFNTYAVGWFRQAPGKEREFVAGITRSGTATDYADSVKGRFTISRDNARNTVYLQMNRLKPEDSAVYYCAAHASYDRMINSEYKYWGQGTQVTVSS

SEQ ID NO: 6301 - protein, 123 aa, Artificial Sequence
  Description of Artificial Sequence: Synthetic polypeptide
QVQLQQSGGGLVQAGGFLRLSCAASGRSFNTYAMGWFRQAPGKEREFVAGITRSGTATEYADSVKGRFTISRDNARNTVLLQMNRLKPEDSAVYYCAAHANYDRMINSEYKYWGQGTQVTVSS

SEQ ID NO: 6302 - protein, 123 aa, Artificial Sequence
  Description of Artificial Sequence: Synthetic polypeptide
QVQLQESGGGLVQAGGFLRLTCAASGRSFNTYAMGWFRQAPGKDRKFVAGITRSGTVTDYADSVKGRFTISRDNARNTVYLQMNRLKPEDSAVYYCAGHASYDRMINSEYKYWGQGTQVTVSS

SEQ ID NO: 6303 - protein, 123 aa, Artificial Sequence
  Description of Artificial Sequence: Synthetic polypeptide
QVQLQESGGGLVQAGGFLRLSCAASGRSFNTYAMGWFRQAPGKEREFVAGITRSGTATDYADSVKGRFTISRDNARNTVYLQMNRLKPEDSAVYYCAAHASYDRMIYSEYKYWGQGTQVTVSS

SEQ ID NO: 6304 - protein, 124 aa, Artificial Sequence
  Description of Artificial Sequence: Synthetic polypeptide
QVQLQESGGGLVQAGDSLRLSCAASGPSFNNGAMSWFRQAPGKEREFVAAIRWSGGGIRYADSVKGRFTISRDNAKNTLYLQMNSLKPEDTAVYYCAIDPRADLVATMTSIRYWGQGTQVTVSS

SEQ ID NO: 6305 - protein, 124 aa, Artificial Sequence
  Description of Artificial Sequence: Synthetic polypeptide
QVQLQESGGGLVQAGDSLRLSCAAPGRSFSGGAMSWFRQVPGKEREFVAAIRWSGGGIRYADSVKGRFTISRDNAKNTFYLQMNSLKPEDTAVYYCAIDPRADLVATMTSIRYWGQGTQVTVSS

SEQ ID NO: 6306 - protein, 124 aa, Artificial Sequence
  Description of Artificial Sequence: Synthetic polypeptide
QVQLQESGGGLVQAGGSLRLSCAASGPSFNNGAMSWFRQAPGKEREFVAAIRWSGGGIRYADSVKGRFTISRDNAKNTLYLQMNSLKPEDTAVYYCAIDPRADLVATMTSIRYWGQGTQVTVSS

SEQ ID NO: 6307 - protein, 124 aa, Artificial Sequence
  Description of Artificial Sequence: Synthetic polypeptide
QVQLQQSGGGLVQAGGSLRLSCAASGRTFSTTGMGWFRQAPGKEREFVAAFWWTGGQTFYADSVKGRFTISGDNAGNTVDLQMNSLKPEDTAVYACAAMSKPRNLWRTDSYDYWGQGTQVTVSS

SEQ ID NO: 6308 - protein, 124 aa, Artificial Sequence
  Description of Artificial Sequence: Synthetic polypeptide
QVQLQESGGGLVQAGGSLRLSCAASGSTFSTYAMGWFRQAPGKEREFVAAFWWTDEQTFYADSVKGRFTISRGNAKNTVDLQMNSLKPEDTAVYACAAMSKPYNLWRTDSYDYWGQGTQVTVSS

SEQ ID NO: 6309 - protein, 122 aa, Artificial Sequence
  Description of Artificial Sequence: Synthetic polypeptide
QVQLQQSGGGLVQSGGSLSLSCAASGITLNNRVVGWFRQAPGKEREFVGRIMWSVGDTFYARSVKGRFTISRDNAKNTMYLQMNALKPEDTAVYYCAAARDPDLYTGQYEYWGQGTQVTVSS

SEQ ID NO: 6310 - protein, 122 aa, Artificial Sequence
  Description of Artificial Sequence: Synthetic polypeptide
QVQLQESGGGLVQPGGSLRLSCSASGFAFDDYAMSWVRQAPGKGLEWVSSINWNGGSTYYAESMKGRFTISRDSAKNTLYLQMNSLKSEDTAVYYCAKGEGSANWGLDFGSWGQGTQVTVSS

SEQ ID NO: 6311 - protein, 107 aa, Artificial Sequence
  Description of Artificial Sequence: Synthetic polypeptide
ELQMTQSPSILSASVGDRVTITCRASQSLNSWVAWYQQAPGRPPTLLISKTSSLESGVPSRFRGGGSGAEFTLTITSLQPDDAASYYCQQYETYPYTFGQGTKVDIK

SEQ ID NO: 6312 - protein, 131 aa, Artificial Sequence
  Description of Artificial Sequence: Synthetic polypeptide
VQLVQSGGDLIQPGGSLRLSCEASGFTFNRNWMHWVRQAPGMGLVWVSRVNSDGTSSTYADSVKGQFTISRDNAKNTLFLQMNSLRVDDTAVYYCARETWYRCDYWGQGTVVTVSSASTKGPSVTSGQAGQ

SEQ ID NO: 6313 - protein, 111 aa, Artificial Sequence
  Description of Artificial Sequence: Synthetic polypeptide
ELVLTQPPSASGTPGQRVTISCSGSRSNIGSKTVKWYQQLPGTAPKLLIHSNNQRPSGVPDRFSGSKSGTSASLAISGLQSGDEADYYCATWDDSLKAVVFGGGTQLTVLG

SEQ ID NO: 6314 - protein, 142 aa, Artificial Sequence
  Description of Artificial Sequence: Synthetic polypeptide
QVQLVQSGAEVKKPGESLKISCEVSGYKFSTYWIAWVRQMPGKGLEWMGSIYPGDSDAKYSPSFQGQVTMSVDKSISTAYLHWGNLKASDTAMYYCARGPYYDSWSGRPLSFWFDPWGQGTLVTVYSASTKGPSVTSGQAGQ

SEQ ID NO: 6315 - protein, 228 aa, Artificial Sequence
  Description of Artificial Sequence: Synthetic polypeptide
EVQLVESGGGLVQPGGSLRLSCAASGYTFTNYWINWVRQAPGKGLEWVGDIYPSDSFTNYNQNFKDRFTISRDKSKNTAYLQMNSLRAEDTAVYYCARSSIYYGKDYVLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 6316 - protein, 231 aa, Artificial Sequence
  Description of Artificial Sequence: Synthetic polypeptide
EVQLLEQSGAEVKRPGASVKVSCKASGYTFTSYAIHWVRQAPGQRLEWMGWINPGNGNAKYSQRFQGRVIISRDTSATTSYMELSSLTSEDTAVYSCARDRGFDLLTGHYLGLDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 6317 - protein, 122 aa, Artificial Sequence
  Description of Artificial Sequence: Synthetic polypeptide
EVQLVESGGGVVQPGRSLRLSCAASGFTFSTYGMHWVRQAPGKGLEWVALILYDGSDKYYADAVRGRFTVSRDNSKSTLYLQMHSLKIEDTAVYYCAILLSAGAANLDNNYGMDVWGRGTTV

SEQ ID NO: 6318 - protein, 139 aa, Artificial Sequence
  Description of Artificial Sequence: Synthetic polypeptide
MYLGLNYVFIVFLLNGVQSEVKLEESGGGLVQPGGSMKLSCAASGFTFSDAWMDWVRQSPEKGLEWVGEIRSKANNHATYYAESVKGRFTISRDDSKSSVYLQMNSLRAEDTGIYYCTPITTGAWFAYWGQGTLVTVSA

SEQ ID NO: 6319 - protein, 142 aa, Artificial Sequence
  Description of Artificial Sequence: Synthetic polypeptide
VVQLVESGGGVVRPGRSLKLSCAASGIAFSTFGMHWVRQAPGQGPEWLAFISYDGTNKHYVDSVKGRFFISRDNSRNVVYLHMNSLRADDTAVYYCATDSAPTGNHYDSSGYLGGSWGQGTRFTVSSASTKGPSVFPLAPLK

SEQ ID NO: 6320 - protein, 118 aa, Artificial Sequence
  Description of Artificial Sequence: Synthetic polypeptide
QVQLQQPGAEFVKPGASVRLSCKASGYTFSSYWMHWVKQRPGQGLEWIGEIDPSDSYTNYNQKFKGKATLTVDKSSSTAYMQFSSLTSEDSAVYYCATSGYDVGVDYWGQGTTLTVSS

SEQ ID NO: 6321 - protein, 129 aa, Artificial Sequence
  Description of Artificial Sequence: Synthetic polypeptide
QVKLLESGGGLVKPGGSLRLSCSASGFSLTKYKMTWVRQAPGKGLEWVSSISSTSRDIDYADSVKGRFTISRDNAKNSLFLQMSSLRVDDTAVYYCTRDGWLWGWDVRSNYYYNALDVWGQGTTVTVSS

SEQ ID NO: 6322 - protein, 123 aa, Artificial Sequence
  Description of Artificial Sequence: Synthetic polypeptide
EVQVLESGGGLVQPGGSLRLSCAASGFRFSSYAMSWVRQAPGKGLEWVSGISGTGENTYYADSVKGRFTISRDNSKNTLYVQMNSLRAEDTAVYYCAKDAILGSGHPWYFHVWGRGTLVTVSS

SEQ ID NO: 6323 - protein, 117 aa, Artificial Sequence
  Description of Artificial Sequence: Synthetic polypeptide
QVQLVQSGGEVKKPGALMKVSCKASGYIFTSYGISWVRQAPGQGLEWIGWINTYSGHTNYARKFRGRVTMTWDTSTSTAYMELSSLRSDDTAVYYCARVPTWGIDYWGQGTLVTVSS

SEQ ID NO: 6324 - protein, 114 aa, Artificial Sequence
  Description of Artificial Sequence: Synthetic polypeptide
QVQLKQSGPGLVKPSQTLSLTCTVSGFSLSTYGVQWVRQPPGKGLEWLGVIWSGGNTDYNAAFISRVTISKDTSKNQVSLKLSSVTAADTAVYYCARARYFDVWGAGTTVTVSS

SEQ ID NO: 6325 - protein, 114 aa, Artificial Sequence
  Description of Artificial Sequence: Synthetic polypeptide
QVQLKQSGPGLVQPSQSLSITCTVSGFSLSTYGVQWVRQSPGKGLEWLGVIWSGGNTDYNAAFISRLSISKDNSKNQVFFKVNSLQADDTAIYYCARARYFDVWGAGTTVTVSS

SEQ ID NO: 6326 - protein, 129 aa, Artificial Sequence
  Description of Artificial Sequence: Synthetic polypeptide
QVQLVESGGGVVRPGRSLRLSCAASGFAFSDYSINWVRQAPGKGLEWVAIISYDGRITYYRDSVKGRFTISRDDSKNTLYLQMNSLRTEDTAVYYCARQYYDFWSGSSVGRNYDGMDVWGLGTTVTVSS

SEQ ID NO: 6327 - protein, 121 aa, Artificial Sequence
  Description of Artificial Sequence: Synthetic polypeptide
QVQLVESGGGVVQPGGSLRLSCAPSGFVFRSYGMHWVRQTPGKGLEWVSLIWHDGSNRFYADSVKGRFTISRDNSKNTLYLQMNSLRAEDTAMYFCARERLIAAPAAFDLWGQGTLVTVSS

SEQ ID NO: 6328 - protein, 122 aa, Artificial Sequence
  Description of Artificial Sequence: Synthetic polypeptide
EVQLVESGGGLVQPGGSLRVSCEVSGFTFSNNWMHWVRQAPGKGPVWVSRISTDGMSTSYAEFVKGRFTISRDNARNTLYLQMNSLRDEDTAVYYCVRGSTYYFGSGSLNFWGQGTTVIVSS

SEQ ID NO: 6329 - protein, 124 aa, Artificial Sequence
  Description of Artificial Sequence: Synthetic polypeptide
QVHLVQSGAGVKKPGASVRVSCKASGYTFTTYPIHWLRQAPGQRPQWMGWIKTGNGDTVYSQKFQGRLTFTRDTSASTVHMELSSLRFEDTAVYYCARDLLSNGWSLSYYFDFWGQGALVTVSS

SEQ ID NO: 6330 - protein, 130 aa, Artificial Sequence
  Description of Artificial Sequence: Synthetic polypeptide
QVHLVESGGGVVQPGRSLRLTCAASGFTFSAYAIHWVRQAPGKGLEWVAVVSADGSNNFYTDSVKGRFTVSRDNPQNTVSLQMNTLRGDDTALYFCARAARGGDGYGAYDDYDYVFQDLWGQGTLVTVSS

SEQ ID NO: 6331 - protein, 126 aa, Artificial Sequence
  Description of Artificial Sequence: Synthetic polypeptide
QVQLQQWGAEMLKPSETLSLSCVVSGGSLSGFYWNWIRQSPGKGFEWLGEVSSVGTANTNPSLQSRVTISADLFKNQFSLKLASVTAADAGVYFCARGRRPTVVKYYYFYDGMDVWGQGTSVIVSS

SEQ ID NO: 6332 - protein, 126 aa, Artificial Sequence
  Description of Artificial Sequence: Synthetic polypeptide
QVKLEESGPGLVKPSGTLSLTCAVSGDSIDRRNWWNWVRQSPGKGLEWIGEIYHSGAANYNPSLKSRVTISVDTSKNHFFLRLSYVTAADTAVYYCARDGLRMDGGWIVTHGFDVWGQGKMVTVSS

SEQ ID NO: 6333 - protein, 124 aa, Artificial Sequence
  Description of Artificial Sequence: Synthetic polypeptide
QVQLQESGPGLVKPSGTLVLTCAVSDGSMSGINWWSWVRQPPGQGPQWIGEIYHTGTTNYNPSLKSRVTMSVDLARSQFSLKLTSVTAADTADYYCARQCQGDGCYGSDAFDFWGQGTRVTVSS

SEQ ID NO: 6334 - protein, 126 aa, Artificial Sequence
  Description of Artificial Sequence: Synthetic polypeptide
QVQLQESGPGLVKPSGTLSLTCTVSGDYINRSQWWDWVRQSPGKGLEWIGEIYHSGTANYNPSLKSRVTISVDTSKNQFSLRLNFVTAADTGVYYCARDGLRMDRGLIVTHGFDAWGQGKMVTVSS

SEQ ID NO: 6335 - protein, 121 aa, Artificial Sequence
  Description of Artificial Sequence: Synthetic polypeptide
QVRLVESGGGVVQPGRSLRLSCAASGFSVTDRGVYWVRQAPGKGLEWVAHLWDDETNKYYADSVKGRFTISRDSSKNTVYLQMNSLRAEDTAVYYCAKDTGYSSGWYLPDWGQGTLVTVSS

SEQ ID NO: 6336 - protein, 121 aa, Artificial Sequence
  Description of Artificial Sequence: Synthetic polypeptide
QAQLTESGGGVVQPGKSLRLACGASGLSFSGYGLHWVRQAPGKGLEYVAGIWHDGSRKNYGPSLRGRFTVSRDDSKNMVFLQMNNVRDEDTGVYFCVREDRFAVGPGFDYWGQGALVTVSS

SEQ ID NO: 6337 - protein, 126 aa, Artificial Sequence
  Description of Artificial Sequence: Synthetic polypeptide
QVQLQQWGAGMLKPSETLSLTCVVSGGSLSGYYWSWVRHSPGKGFEWLGEVSSVGTANNNPSLQSRVALSADLFKNQFSLKLTSLTAADTGVYYCARGRRPTLVKYYYFYHGMDVWGQGTAVIVSS

SEQ ID NO: 6338 - protein, 128 aa, Artificial Sequence
  Description of Artificial Sequence: Synthetic polypeptide
QVQLQESGPGLVRPSETLSLICTVSGDSINNINYYWGWVRQSPGKGLEWIGSIYHHGSTYYNPSLKSRVAMSVDKAKNQFSLKLRSVTAADTAVYYCSRQKVELRFLEWFRLHDSDVWGQGTMVTVSS

SEQ ID NO: 6339 - protein, 123 aa, Artificial Sequence
  Description of Artificial Sequence: Synthetic polypeptide
QVHLVQSGAEVKKPGASVKLSCKTSGYSFNNYMIHWVRQAPGQRLEWMGWISGGNGNTQYSKYFQGRVTFSRDTPATTVYMELSSLKSGDTAVYYCARGAKDSWRPEYYFDYWGQGSQVTVSS

SEQ ID NO: 6340 - protein, 122 aa, Artificial Sequence
  Description of Artificial Sequence: Synthetic polypeptide
QVQLVESGGGLVKPGGSLRLSCSASGFSFSDHYMSWIRQAPGKGLEWIAYIGTSRGTIFYTDSVKGRFTISRDNAKRSVFLQMNSLRAEDTAIYYCAGPGCWGGSCYPFTYWGQGALVTVSS

SEQ ID NO: 6341 - protein, 122 aa, Artificial Sequence
  Description of Artificial Sequence: Synthetic polypeptide
QVQLVESGGGVVQPGRSLRLSCAASRVTFSSYAMHWVRQAPGKGLEWVAVISHDGSKIYYADSVRGRFTISRDNSKNVFYLQTSSLRTDDTAIYYCAKSDILFGLSGGLDYWGQGTRVTVTS

SEQ ID NO: 6342 - protein, 120 aa, Artificial Sequence
  Description of Artificial Sequence: Synthetic polypeptide
DMQLLESGGGLVQPGGSLRLSCAASGFPFSNHAMAWVRQAPGQGLEWVSEIRDDHSEHYADSVKGRFTISRDNARNTLYLQMSSLRAEDTAFYYCAKDHGGLWLGEPPDWGQGTLVTVSS

SEQ ID NO: 6343 - protein, 122 aa, Artificial Sequence
  Description of Artificial Sequence: Synthetic polypeptide
QVQLVESGGGLVKPGGSLRLSCAASGFTFSDHYMSWIRQAPGKGLEWIAYIGTSRGTIFYADSVEGRFSISRDNAKNSVYLQMSSLRAEDTATYYCAGPGCWGGSCYPFHYWGQGALVTVSS

SEQ ID NO: 6344 - protein, 127 aa, Artificial Sequence
  Description of Artificial Sequence: Synthetic polypeptide
QLQLQESGPGLVKPSETLSLICSVFGGSVRSSRYYWAWIRQSPGKGLEWIGSMFHSGSTSYNPSLNSRVTISVDVFKNQFSLKLTSVTAADTAVYYCARQSYSDIWSGYGLHWFDPWGQGTLVTVSS

SEQ ID NO: 6345 - protein, 124 aa, Artificial Sequence
  Description of Artificial Sequence: Synthetic polypeptide
QMQVVESGGGVVQPGRSRRLSCEGSGFRFNSYGMHWVRQAPGKGLEWVAGTAADGSKKYYADSVKGRFTISKDNSKNTVYLQMNSLRPEDTAMYYCAKDSILLTSNPGVGIDVWGQGTTVTVSS

SEQ ID NO: 6346 - protein, 122 aa, Artificial Sequence
  Description of Artificial Sequence: Synthetic polypeptide
QVQLVQSGSELKKPGASVKLSCKASGYPFTGFAMHWVRQAPGQGLEWMGWINTHNGNPRYAQGFTGRFVFSLDTSVTTAYLQISSLKAEDTAVYYCAREATNYAYAYGMDVWGQGTAITVSS

SEQ ID NO: 6347 - protein, 121 aa, Artificial Sequence
  Description of Artificial Sequence: Synthetic polypeptide
QVRLVQSGAELRKPGASVKVSCKASGYEFSTHAIHWVRQAPGQRLEWMGWVNIRNGNTQYSQKFQGKVTLTRDTSATTAYMELNSLRSEDTAVYFCAREGYDGSPFSPLDHWGQGALIIVS

SEQ ID NO: 6348 - protein, 126 aa, Artificial Sequence
  Description of Artificial Sequence: Synthetic polypeptide
QVQLQQWGAGMLKPSETLSLSCVVSGGSLSGFYWNWIRQSPGKGFEWLGEVSSVGTANTHPSLQSRVTISADLFKNQFSLKLASVTAADAGVYFCARGRRPTVVKYYYFYDGMDVWGQGTSVIVSS

SEQ ID NO: 6349 - protein, 126 aa, Artificial Sequence
  Description of Artificial Sequence: Synthetic polypeptide
QVQLQQWGAEMLKPSETLSLSCVVSGGSLSGFYWNWIRQSPGKGFEWLGEVSSVGTANTNPSLQSRVTISADLFKNQFSLKLSSVTAADAGVYFCARGRRPTVVKYYYFYDGMDVWGQGTSVIVSS

SEQ ID NO: 6350 - protein, 126 aa, Artificial Sequence
  Description of Artificial Sequence: Synthetic polypeptide
QVQLQQWGAGMLKPSETLSLTCVVSGGSLSGFYWSWIRQSPGKGFEWLGEVSSVGTANTNPSLQSRVTISADLFKNQFSLKLASLTAADAGVYYCARGRRPTLVKYYYFYDGMDVWGQGTTVIVSS

SEQ ID NO: 6351 - protein, 126 aa, Artificial Sequence
  Description of Artificial Sequence: Synthetic polypeptide
QVQLQQWGAGMLKPSETLSLTCVVSGGSLSGYYWSWVRHPPGKGFEWLGEVSSVGTANNNPSLQSRVALSADLFKNQFSLKLTSLTAADTGVYYCARGRRPTLVKYYYFYHGMDVWGQGTAVIVSS

SEQ ID NO: 6352 - protein, 126 aa, Artificial Sequence
  Description of Artificial Sequence: Synthetic polypeptide
QVQLQQWGAGMLKPSETLSLTCVVSGGSLSGYYWSWVRHSPGKGFEWLGEVSSVGTANNNPSLQSRVALSADLFKNQFSLKLTSLTAVDTGVYYCARGRRPTLVKYYYFYHGMDVWGQGTAVIVSS

SEQ ID NO: 6353 - protein, 129 aa, Artificial Sequence; identical to SEQ ID NO: 6321
  Description of Artificial Sequence: Synthetic polypeptide

SEQ ID NO: 6354 - protein, 142 aa, Artificial Sequence
  Description of Artificial Sequence: Synthetic polypeptide
MEFGLSWVFLVALLRGVQCQVQLVESGGGVVQPGRSLRLSCAASGFTFSRYGHHWVRQAPGKGLEWVAVISYDGSNKWYADSVKGRFTDISRDNSKNTLFLQHHSLRAADTGVYYCAKDQLYFGSQSPGHYWVQGTLVTVSS

SEQ ID NO: 6355 - protein, 131 aa, Artificial Sequence
  Description of Artificial Sequence: Synthetic polypeptide
MEFGLSWVFLVAILEGVQCEVQLVESGGGLVQPGGSLRLSCAASGFTFSRYDMYWVRQATGKGLEWVSAIGPTGDTYYADSVKGRFTISRENAKNSLYLTMNGLRAGDTAVYYCARDLELWGQGTLVTVSS

SEQ ID NO: 6356 - protein, 132 aa, Artificial Sequence
  Description of Artificial Sequence: Synthetic polypeptide
MKHLWFFLLLVAVPRWVVSQYQLQESGPGLVKASETLSLTCTVSRGSFSDYFWNWFRQPAGKRLEWLGRVYTSGSVDYHPSLKSRVTVSVDTSKKQFSLRLSSVTVADTAVYYCARGLSGFDYWGQGALVTV

SEQ ID NO: 6357 - protein, 147 aa, Artificial Sequence
  Description of Artificial Sequence: Synthetic polypeptide
MGSTAILGLLLAVLQGVCAEVQLVQSGAEVKKPGESLRISCKGSGYSFTSYWISWVRQHPGKGLEWMGRLDPSASSAIFSPSLQGHVTISVDKSMRTAYVQWRSLKASDTAMYYCARHVREKSMVQGVIIKDAFDIWGQGTMVTVSS

SEQ ID NO: 6358 - protein, 147 aa, Artificial Sequence
  Description of Artificial Sequence: Synthetic polypeptide
MGWSCIILFLVATATGVHSQVQLQESGPRLVKWSQTLSLTCSVAGDSISSAESYWNWVRQSPGKGLQWIGFIFYTGTTYFNPSLNSRLTMSKDFVKNQFSLTLSSVSAADSAVYYCARGRGSTFPSAQFSYFGLDVWGQGTTVTVSS

SEQ ID NO: 6359 - protein, 148 aa, Artificial Sequence
  Description of Artificial Sequence: Synthetic polypeptide
MGWSCIILFLVATATGVHSQLQLQESGPGLVKPSETLSLTCIVSGGSIGTTDHYWGWIRQSPGKGLEWIGTTYYSGKTYYNPSLNSRVTISIDTSKNHFSLRLISVTAADTAVYHCARHRANYDFWGGSNLRGYFDPWGRGTLVTVSS

SEQ ID NO: 6360 - protein, 137 aa, Artificial Sequence
  Description of Artificial Sequence: Synthetic polypeptide
QVDLVESGAEVKKPGASVKLSCKASGYTLTRYYIHWVRQAPGQGLAWMGIINPSGGSTTYAQKFQDRVLMTTDISTSTVYLELSGLRSEDTAMYYCAEGNYHDSSGHQYADWQLAPNWLDSWGQGTLVTVSSASTKG

SEQ ID NO: 6361 - protein, 137 aa, Artificial Sequence
  Description of Artificial Sequence: Synthetic polypeptide
QVDLVESGAEVKKPGASVKLSCKASGYTLTRYYIHWVRQAPGQGLAWMGIINPSGGSTTYAQKFQDRVLMTTDISTSTVYLELSGLRSEDTAMYYCADGNYHDSSGHQYADWQLAPNWLDSWGQGTLVTVSSASTKG

SEQ ID NO: 6362 - protein, 120 aa, Artificial Sequence
  Description of Artificial Sequence: Synthetic polypeptide
QVQLVESGGGVVQPGGSLRLSCAPSGFVFRSYGMHWVRQTPGKGLEWVSLIWHDGSNRFYADSVKGRFTISRDNSKNTLYLQMNSLRAEDTAMYFCARERLIAAPAAFDLWGQGTLVTVS

SEQ ID NO: 6363 - protein, 129 aa, Artificial Sequence; identical to SEQ ID NO: 6326
  Description of Artificial Sequence: Synthetic polypeptide

SEQ ID NO: 6364 - protein, 115 aa, Artificial Sequence
  Description of Artificial Sequence: Synthetic polypeptide
QVQLQQSGPELVKPGASVKISCKASGYAFSSSWMNWVKQRPGQGLEWIGRIYPGDGDTNYNGKFKGKATLTADKSSSTAYMQLSSLTSVDSAVYFCAREYDEAYWGQGTLVTVSA

SEQ ID NO: 6365 - protein, 98 aa, Artificial Sequence
  Description of Artificial Sequence: Synthetic polypeptide
QVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCAR

SEQ ID NO: 6366 - protein, 115 aa, Artificial Sequence
  Description of Artificial Sequence: Synthetic polypeptide
QVQLVQSGAEVVKPGASVKVSCKASGYAFSSSWMHWVRQAPGQGLEWIGRIYPGDGSTSYAQKFQGKATLTADKSTSTAYMELSSLRSEDTAVYFCAREYDEAYWGQGTLVTVSS

SEQ ID NO: 6367 - protein, 123 aa, Artificial Sequence
  Description of Artificial Sequence: Synthetic polypeptide
QVQLVESGGGVVQPGRSLRLSCTASGFTFNNYGMHWVRQTPGKGLEWLAVIWFDENNKYYADSVRGRFTISRDNSKNTLFLQMNSLKTEDTAMYYCARDISLVRDAFIYFDFWGLGTLVTVSS

SEQ ID NO: 6368 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWFDGNNQYYADSVKGRFTISRDNSKNTLYLQMNSLRAEDTAVYYCARDIFTVVRGFFIYFDYWGQGTLVTVSS

SEQ ID NO: 6369 - protein, 126 aa, Artificial Sequence
  Description of Artificial Sequence: Synthetic polypeptide
QVQLVESGGGVVQPGRSLRLSCAASGFTFSNYGMHWVRQAPGKGLEWMAVIWYDENNRYSADSVKGRFTISRDNSKNTLYLQMNSLRAEDTAVYYCARDPTNYHGSGSYYIYFDYWGQGTLVTVSS

SEQ ID NO: 6370 - protein, 127 aa, Artificial Sequence
  Description of Artificial Sequence: Synthetic polypeptide
AEVQLLESGGGLVQPGRSLRLSCAASGFTFDDYGMHWVRQAPGKGLEWVSGLSWNSDNIGYADSVKGRFTISRDNAKNSLYLQMNSLKIEDTAFYYCAKAPRTLRFLEWHNVYFDLWGRGTLVTVSS

SEQ ID NO: 6371 - protein, 133 aa, Artificial Sequence
  Description of Artificial Sequence: Synthetic polypeptide
AEVQLLEQSGAEVKKPGESLRISCRGSGYSFPNYWVSWVRQMPGKGLEWMGKIDPSDSETNYSPSFQGHVTISADKSLSIAYLQWNSLKASDTAMYHCARHKRGAPTYKDILTGYYVDGMDVWGQGTTDTVSS

SEQ ID NO: 6372 - protein, 125 aa, Artificial Sequence
  Description of Artificial Sequence: Synthetic polypeptide
AEVQLLESGPGLVKPSETLSLTCTVSNGSMSNYCWSWIRQSPGKGLEWIGYIYYSGSTSYNPSLRSRVALLVDTSKNQFSLKLTSVTTADTAVYYCARDLSARGGTRNRDALDVWGQGTQVTVSA

SEQ ID NO: 6373 - protein, 127 aa, Artificial Sequence
  Description of Artificial Sequence: Synthetic polypeptide
AEVQLLESGGGLVEPGRSLRLSCAASGFNFGDYAIHWVRQGPGKGLEWVAGISWNSGSIGYADSVKGRFIISRDNAKKTLFLQMNTLRTEDTALYYCVKETGAQGVAGSGAYYFHNWGQGTLVTVSS

SEQ ID NO: 6374 - protein, 121 aa, Artificial Sequence
  Description of Artificial Sequence: Synthetic polypeptide
AEVQLLESGPGLVKPSETLSLTCTVSGNSISSGYYWVWFRQSPGKGLEWIASIYHSGSTYYNPSLRSRVSISVDTSKKQFSLKLSSVTAADTAVYYCARDSAKTTRYFVHWGQGTLVTVSS

SEQ ID NO: 6375 - protein, 132 aa, Artificial Sequence
  Description of Artificial Sequence: Synthetic polypeptide
AEVQLLESGAEVKKPGESLRISCRGSGYSFPNYWVSWVRQMPGKGLEWMGKIDPSDSETNYSPSFQGHVTISADKSLSIAYLQWNSLKASDTAMYYCARHKRGAPTYKDILTGYYVDGMDVWGQGTTVTVSS

SEQ ID NO: 6376 - protein, 125 aa, Artificial Sequence
  Description of Artificial Sequence: Synthetic polypeptide
AEVQLLEQSGAEVKKPGASVKVSCKASGYTFTKYYLHWVRQAPGQGLEWMGFINPSGGSTSSAQKFQGRISMTRDTSTTTVYMEVNSVTSEDTAVYYCARVGRLGVGATGAFDLWGQGTMVTVSS

SEQ ID NO: 6377 - protein, 128 aa, Artificial Sequence
  Description of Artificial Sequence: Synthetic polypeptide
AEVQLLESGPGLVKPSQTLSLTCAISGDNVSRKSAAWNWIRQSPSRGLEWLGRTYHMSKWYSVYATSLKSRININVDTSRNQFALQLRSVTPEDTAVYYCAREGPEWAVGGTYGMDVWGQGTTVTVSS

SEQ ID NO: 6378 - protein, 130 aa, Artificial Sequence
  Description of Artificial Sequence: Synthetic polypeptide
AEVQLLEQSGAEVKKPGASVKVSCKASGYTFTGYYMHWVRQAPGQGLEWMGWINPESGATNYAQNFQGRVTMTTDTSMRTAYIEVSRLRSDDTAVYFCARGGAFCTGGTCYFAIYGMDVWGQGTAVIVSS

SEQ ID NO: 6379 - protein, 121 aa, Artificial Sequence
  Description of Artificial Sequence: Synthetic polypeptide
AEVQLLESGGGLVKPGGSLRLSCAASGFTFSNAWMSWVRQAPGKGLEWVGRIKSKTDGGTIDYAAPVKGRFTISRDDSKNTLYLQMNSLKTEDTAVYYCTTWDGDHAVDYWGQGTLVTVSS

SEQ ID NO: 6380 - protein, 120 aa, Artificial Sequence
  Description of Artificial Sequence: Synthetic polypeptide
AEVQLLESGPGLVKPSETLSLTCTVSTGSISGYFWSWIRQPPGKGLEWIAYIHNSGNTNYNPSLRSRVTVSIDTSKNQFSLKLTSVTAADTAVYYCARDGGGWDTYLDSWGQGFLVTVSS

SEQ ID NO: 6381 - protein, 120 aa, Artificial Sequence
  Description of Artificial Sequence: Synthetic polypeptide
AEVQLLESGPGLVKPSETLSLTCTVSGGSISDYYWSWIRQPPGKGLEWIGHTYDNGGTKYNPSLKSRASISVDTSKNQVSLRLTSVTAADTAVYYCATAFLDNSGWYTFDSWGQGSLVTV

SEQ ID NO: 6382 - protein, 121 aa, Artificial Sequence
  Description of Artificial Sequence: Synthetic polypeptide
AEVQLLEQSGGGVVQPGRSLRLSCAASGFTFSTYAMHWVRQAPGKGLEWVAVISHDGSNKFYADSVKGRFTISRDSSKNTLYLQMNSLRPGDTAVYYCSRWDRRAEYFQDWGQGTLVTVSS

SEQ ID NO: 6383 - protein, 118 aa, Artificial Sequence
  Description of Artificial Sequence: Synthetic polypeptide
AEVQLLESGAGVVQPGKSLTLSCVGSGFTFSIYAMHWVRQAPGKGLEWVAVLSSDGSNDYYADSVKGRFSIFRDTSKNSLNLLMNNVRGEDTAVYYCARDGDGSFFYWGQGTLVTVSS

SEQ ID NO: 6384 - protein, 118 aa, Artificial Sequence
  Description of Artificial Sequence: Synthetic polypeptide
AEVQLLEQSGAEVKKPGASVKVSCKASGYMFTCYYMHWVRQAPGQGLEWMGMVNPTGGSSSYAQKFQGRVTMTKGHVTSTVYMELSSLRSEDTAVYYCATGMVRGDEWGQGTLVTVSS

SEQ ID NO: 6385 - protein, 126 aa, Artificial Sequence
  Description of Artificial Sequence: Synthetic polypeptide
AEVQLLEQSGGGLVQPGGSLRLSCTASGFTLTDYSMDWVRQAPGKGPEWVGRSRNKANIYTTEYAASVKGRFVISRDDSENSVYLQMNNVKMDDTAVYYCARGEGIFYGSGSLDLWGQGAVVTVSS

SEQ ID NO: 6386 - protein, 126 aa, Artificial Sequence
  Description of Artificial Sequence: Synthetic polypeptide
AEVQLLEQSGGDLVKPGGSLRLSCAASGFTFTDYYMNWIRQAPGKGLEWIAYISIGSDDTKYAASVKGRFSISRDNAKNSLYLQMNSLRVEDTAVYYCGRGGGYCSGGNCYSSDYWGQGALVTVSS

SEQ ID NO: 6387 - protein, 131 aa, Artificial Sequence
  Description of Artificial Sequence: Synthetic polypeptide
AEVQLLEQSGGGLVQPGRSLRLSCAASGFTFDDYAMHWVRQTPGKGLEWVSGIGWNSGTIEYADSVKGRFTISRDNAKNSLYLQMNSLRPEDTALYYCAKDLHSFGYCSGRSCYFHPFDYWGQGTLVTVSS

SEQ ID NO: 6388 - protein, 118 aa, Artificial Sequence
  Description of Artificial Sequence: Synthetic polypeptide
AEVQLLESGGGLVQPGRSLRLSCAASGFTFSNSDMHWVRQAPGKGLEWVTVSSRDGYDNYYADSVRGRFTISRDNSKNTLYLQMNTLRAEDTAVYYCAKRRGYAFDIWGQGTMVTVSS

SEQ ID NO: 6389 - protein, 128 aa, Artificial Sequence
  Description of Artificial Sequence: Synthetic polypeptide
AEVQLLEQSGGGLVKPGGSLRLSCTASGFTFSGFTFSDHYMSWIRQAPGKGLELVSYIISNGYTNYPDSVKGRFTVSRDNARKSLYLQMNSLRVEDTAIYYCARGLSPSIAGDGFDIWGQGTMVTVSS

SEQ ID NO: 6390 - protein, 116 aa, Artificial Sequence
  Description of Artificial Sequence: Synthetic polypeptide
AEVQLLESGPRLVKPSQTLSLTCTVSGDSLNNASHYWAWIRQPAGKGLEWIGRIHRGGSTNYNPSLQSRVTISMDESKNQFSLRLNSVTAADTAVYYCARDPPKAWGPGILVTVSS

SEQ ID NO: 6391 - protein, 121 aa, Artificial Sequence
  Description of Artificial Sequence: Synthetic polypeptide
AEVQLLESGAEVKKPGASVTVSCKASGYSFSDYYIHWVRQAPGQGLEWMGIINPSAGTTTYKQKFQHRVTLTRDTSTNTAYMKLYNLTPDDTAIFFCARGSGGSRSEYDYWGQGTLVTVSS

SEQ ID NO: 6392 - protein, 121 aa, Artificial Sequence
  Description of Artificial Sequence: Synthetic polypeptide
AEVQLLESGGEVKKPGSSVKVSCKASGGPFSSYAIHWVRQAPGQGLEWMGAIIPFLGRAKYAQKFEGRVTITADGSMSTAYMEVSSLRSDDTAMYYCARDRGELLLRMDVWGQGTAVTVSS

SEQ ID NO: 6393 - protein, 128 aa, Artificial Sequence
  Description of Artificial Sequence: Synthetic polypeptide
AEVQLLESGGGVVQPGRSLRLSCAASGFTLSTYAMHWVRQAPGRGLEWVAVISYDGDHKFYADSMKGRFAISRDTSTNTLYLEVNSLKIEDTAVYYCARDRDRRGGYVFSTTGGLDSWGQGTLVTVSS

SEQ ID NO: 6394 - protein, 123 aa, Artificial Sequence
  Description of Artificial Sequence: Synthetic polypeptide
AEVQLLEQSGAEVKKPGESLKISCRASGYSFSLFWVAWVRQMPGQGLEWMAIIYPGDSDTTYSPSFEGQVNVSVDKPISTAYLQWSSLKASDTAMYYCARRRSSDRRDAFDIWGPGTMVTVSS

SEQ ID NO: 6395 - protein, 128 aa, Artificial Sequence
  Description of Artificial Sequence: Synthetic polypeptide
AEVQLLESGPGLVQPSQTLSLTYAISGDSVSSNSAAWTWIRQSPSRGLEWLGMTYYRSQWYHEYAVSLKSRITINADTSNNQFSLQVNSVTPEDTALYYCARARFVGDTTGYYTFDYWGQGTLVTVSS

SEQ ID NO: 6396 - protein, 127 aa, Artificial Sequence
  Description of Artificial Sequence: Synthetic polypeptide
AEVQLLESGGGVVQPGRSLKLSCTASTFTFTNYAMHWVRQAPGKGLEWVALISNDGSKTYYTDSVRGRFTISRDNSKNTLFLQMNSLRTEDTAVYHCARVKLQGSFNVYYYYGLDVWGQGTTVTVSS

SEQ ID NO: 6397 - protein, 118 aa, Artificial Sequence; identical to SEQ ID NO: 6388
  Description of Artificial Sequence: Synthetic polypeptide

SEQ ID NO: 6398 - protein, 109 aa, Artificial Sequence
  Description of Artificial Sequence: Synthetic polypeptide
AELTQSPSSLSASVGDRVTITCRASQGISRYLAWFQQRPGKAPKSLIYAASHLQSGVPSRFSASGSGTEFTLSISSLQPEDFATYYCQQYDTYPYTFGQGTKLEIKRTV

SEQ ID NO: 6399 - protein, 124 aa, Artificial Sequence
  Description of Artificial Sequence: Synthetic polypeptide
QVQLVESGGGVVQPGRSLRLSCAASGFILSSYGMHWVRQAPGKGLEWVAVIWYDGNNKYYADSVKGRFTISRDNSKNTLYLQMNSLRAEDTAVYYCARDIFTMVRGVFIYFDYWGQGTLVTVSS

SEQ ID NO: 6400 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWLDGSNTYYADSVKGRFTISRDNSKNTLFLQMNSLRAEDTAVYYCARDIFTVARGVIIYFDYWGQGTLVTVSS

SEQ ID NO: 6401 - protein, 124 aa, Artificial Sequence
  Description of Artificial Sequence: Synthetic polypeptide
QVQLVESGGGVVQPGRSLRLSCAASGFTFSNYGMHWVRQAPGKGLEWVAVIWFDGNNKYYADSVKGRFTISRDNSKNTLYLQMNSLRAEDTAVYYCARDIFTMDRGVFIYFDYWGQGTLVTVSS

SEQ ID NO: 6402 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDESNKYYADSVKGRFTISRDNSKNTLYLQMNSLRAEDTAVYYCARDIFTMVRGVFIYFDYWGQGTLVTVSS

SEQ ID NO: 6403 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWFDGNNKYYADSMKGRFTISRDNSKNTLYLQMNSLRAEDTAVYYCARDIFTMVRGVFIYFDYWGQGTLVTVSS

SEQ ID NO: 6404 - protein, 124 aa, Artificial Sequence
  Description of Artificial Sequence: Synthetic polypeptide
QVQLVESGGGVVQPGRSLRLSCAASGFTLSSYGMHWVRQAPGKGLEWVAVIWYDGNNKYYADSVKGRFTISRDNSKNTLYLQMDSLRAEDTAVYYCARDIFTMVRGVFIYFDYWGQGTLVTVSS

SEQ ID NO: 6405 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWFDGNNKYYADSVKGRFTISRDNSKNTLYLQMNSLRAEDTAVYYCARDIFTMVRGVFIYFDYWGQGTLVTVSS

SEQ ID NO: 6406 - protein, 124 aa, Artificial Sequence
  Description of Artificial Sequence: Synthetic polypeptide
QVQLVESGGGVVQPGRSLRLSCAASGFTFSSYGMHWVRQAPGKGLEWVAVIWYDENNKYYADSVKGRFTISRDNSNNTLYLQMNSLRAEDTAVYYCARDIFTMVRGVFIYFDYWGQGTLVTVSS

SEQ ID NO: 6407 - protein, 124 aa, Artificial Sequence
  Description of Artificial Sequence: Synthetic polypeptide
QVQLVESGGGVVQPGRSLRLSCAASGFTLSSYGMHWVRQAPGKGLEWMAVIWYDGNNKYYADSVKGRFTISRDNSKNTLYLQMNSLRAEDTAVYYCARDIFTMVRGVFIYFDYWGQGTLVTVSS

SEQ ID NO: 6408 - protein, 123 aa, Artificial Sequence
  Description of Artificial Sequence: Synthetic polypeptide
QVQLVQSGAEVKKPGSSVKVSCEASGGTLSNYVITWVRQAPGQGLEWMGGFIPTFRTAMYAQGFQGRVTITADESTSIAYMELTNLRSEDTAVYYCARGPLSRGYYDYWGQGTLVTVSSGSTG

SEQ ID NO: 6409 - protein, 127 aa, Artificial Sequence
  Description of Artificial Sequence: Synthetic polypeptide
QVQLVQSGSEVKKPGSSVKVSCKASGGTFNIYTVNWVRQAPGQGLEWMGRIIPMLGSADYAQRFQGRVTISADKSTSTAYMELRNLKSEDTAVYYCARSLPREMFFRDDAFDIWGQGTMVTVSSGST

SEQ ID NO: 6410 - protein, 159 aa, Artificial Sequence
  Description of Artificial Sequence: Synthetic polypeptide
LPREMFFRDDAFDIWGQGTMVTVSSGSTQVQLVQSGAEVKKPGSSVKVSCKASGTSFNRYTFAWVRQAPGQGLEWVGTIIPIVGLTNYAEKFQGRVSITADKSTSTTYMELSSLRSEDTAVYFCARKVEFWLGEIAPNKFDVFDLWGQGTMVTVSSGST

SEQ ID NO: 6411 - protein, 132 aa, Artificial Sequence
  Description of Artificial Sequence: Synthetic polypeptide
EVQLVQSGAEVKKPGSSVKVSCKASGDTFSSYSIHWVRQAPGQGLEWMGRIIPIVGLVDYAQMFQGRVTISADRSTNTVYMDLSNLRSEDTAIYYCARSLGCPNGVCHGPRAADYFDYWGQGTLVTVSSGST

SEQ ID NO: 6412 - protein, 132 aa, Artificial Sequence
  Description of Artificial Sequence: Synthetic polypeptide
QVQLVESGAEVKKPGSSVKVSCKASGDTFSSYSIHWVRQAPGQGLEWMGRIIPIVGLVDYAQMFQGRVTISADRSTNTVYMDLSNLRSEDTAYYCARASLGCPNGVCHGPRAADYFDYWGQGTLVTVSSGST

SEQ ID NO: 6413 - protein, 127 aa, Artificial Sequence
  Description of Artificial Sequence: Synthetic polypeptide
QVQLVQSGAEVKKPGSSVKVSCKASGGTFSLNSLSWVRQAPGQGLEWMGTIIPIVGIANYAQKFQGRVTITADKSTGTAYMDLSSLSDDTAVYFCARELYSGTGFFRLEALDYWGQGTLVTVSSGST

SEQ ID NO: 6414 - protein, 119 aa, Artificial Sequence
  Description of Artificial Sequence: Synthetic polypeptide
QVQLQQSGAEVKKPGSSVKVSCEASGGTLSNYVITWVRQAPGQGLEWMGGFIPTFRTAMYAQGFQGRVTITADESTSIAYMELTNLRSEDTAVYYCARGPLSRGYYDYWGQGTLVTVSS

SEQ ID NO: 6415 - protein, 119 aa, Artificial Sequence
  Description of Artificial Sequence: Synthetic polypeptide
QVQLVQSGAEVKKPGSSVKVSCEASGGTLSNYVITWVRQAPGQGLEWMGGFIPTFRTAMYAQGFQGRVTITADESTSIAYMELTNLRSEDTAVYYCARGPLSRGYYDYWGQGTLVTVSS

SEQ ID NO: 6416 - protein, 119 aa, Artificial Sequence
  Description of Artificial Sequence: Synthetic polypeptide
QVTLKESGAEVKKPGSSVKVSCEASGGTLSNYVITWVRQAPGQGLEWMGGFIPTFRTAMYAQGFQGRVTITADESTSIAYMELTNLRSEDTAVYYCARGPLSRGYYDYWGQGTLVTVSS

SEQ ID NO: 6417 - protein, 112 aa, Artificial Sequence
  Description of Artificial Sequence: Synthetic polypeptide
QIQLVQSGPELKKPGETVKISCKASGYSFTDYSMHWMKQTPGKGLKWMGWINTETGQPTYADDFKGRFAFSLETSASTAYLQINNLKNEDTATYFCALWDYWGQGTTLTVSS

SEQ ID NO: 6418 - protein, 118 aa, Artificial Sequence
  Description of Artificial Sequence: Synthetic polypeptide
QVQLQQPGAELVKPGTSVKLSCKASGYTFTSYWMHWVKLRPGQGFEWIGEINPRYGDTSYNERFKRKATLTVDKSSSTAYMQLSSLTSEDSAVYYCSTDDYDRGFAYWGQGTLVTVSA

SEQ ID NO: 6419 - protein, 115 aa, Artificial Sequence
  Description of Artificial Sequence: Synthetic polypeptide
QLQQFGAELVKPGASVKISCKASGYTFTDYNMDWVKQSLGKSLEWIGDINPNDDSTNYNQKFKGKATLTVDKSSRTAYMELRSLTSEDTAVYYCAREGYWYFDVWGAGTTVTVSS

SEQ ID NO: 6420 - protein, 118 aa, Artificial Sequence
  Description of Artificial Sequence: Synthetic polypeptide
QVTLKESGPGILQPSQTLSLTCSFSGFSLSTYGIGVGWIRQPSGKGLEWLAHIWWNDDNYYNTALKSRLTISKDTSNNQVFLKIASVDTVDTATYYCVRIGGPAMDYWGQGTSVTVSS

SEQ ID NO: 6421 - protein, 120 aa, Artificial Sequence
  Description of Artificial Sequence: Synthetic polypeptide
QVQLQQPGAELVMPGASVKMSCKASGYTFTDYWMHWVKQRPGQGLEWIGAIDTSDSQTDYNQKYRGKATLTVDESASTAYMQLNSLTSEDSAVYYCATIYYDYDGSFDQWGQGTTLTVSS

SEQ ID NO: 6422 - protein, 105 aa, Artificial Sequence
  Description of Artificial Sequence: Synthetic polypeptide
  MOD_RES (50)..(50): Any amino acid
  MOD_RES (60)..(60): Any amino acid
FEVQLEESGGGLVQPGGSRKLSCAASGFTFSSFGMHWVRQAPEKGLEWVXYISSGSSTLXYADTVKGRFTISRDNPKNTLFLQMKLPSLCYGLLGPRDHGHRLLK

SEQ ID NO: 6423 - protein, 115 aa, Artificial Sequence
  Description of Artificial Sequence: Synthetic polypeptide
FEVQLEESGPGLVKPSQSLSLTCTVTGYSITSDYAWSWIRQFPGNKLEWMAYIGYSGNTSYNPSLKSRISVTRDTTKNQFFLRLKSVTTEDTATYYCSAVDGSYWGQGTTVTVSS

SEQ ID NO: 6424 - protein, 154 aa, Artificial Sequence
  Description of Artificial Sequence: Synthetic polypeptide
MELVWTSFPLCLYSVIFFLMAVVTGVNSEVLLQQSGSDLVRPGALVNLSCKASGFNVQDFYIHWVKQRPEQGLEWIGWIDPDIGHTIYDPKFQGKASLAVDTSSNTAYLQLSSLTSGDTAVYYCARGLLTFFDVWGAGTTVTVSSPPSVYPLAP

SEQ ID NO: 6425 - protein, 141 aa, Artificial Sequence [sequence omitted]

SEQ ID NO: 6426 - protein, 121 aa, Artificial Sequence
  Description of Artificial Sequence: Synthetic polypeptide
  MOD_RES (34)..(34): Any amino acid
  MOD_RES (83)..(83): Any amino acid
QVQLVESGGGLVQPGGSLRLSCAASGFTFSSYAXSWFRQAPGKEREIVSAVSGSGGSTYYADSVRGRFTISRDNSKNTLYLQXNSLRAEDTAVYYCAREPRIPRPPSFDYWGQGTLVTVSS

SEQ ID NO: 6427 - protein, 107 aa, Artificial Sequence
  Description of Artificial Sequence: Synthetic polypeptide
VKLQESGPELVKPGASVKISCKASGYSFTNYYINWVKQRPGQGLEWIGWIFPGGGNTKYSEKFKDKATVTADTSSSTAYMQLSGLTSEDSAVYFCSRDIYGDAWFAY

SEQ ID NO: 6428 - protein, 129 aa, Artificial Sequence; identical to SEQ ID NO: 6321
  Description of Artificial Sequence: Synthetic polypeptide

SEQ ID NO: 6429 - protein, 129 aa, Artificial Sequence
  Description of Artificial Sequence: Synthetic polypeptide
EVQLVESGGGLVKPGGSLRLSCSASGFSLTKYKMTWVRQAPGKGLEWVSSISSTSRDIDYADSVKGRFTISRDNAKNSLFLQMSSLRVDDTAVYYCTRDGWLWGWDVRSNYYYNALDVWGQGTTVTVSS

SEQ ID NO: 6430 - protein, 117 aa, Artificial Sequence; identical to SEQ ID NO: 6323
  Description of Artificial Sequence: Synthetic polypeptide

SEQ ID NO: 6431 - protein, 117 aa, Artificial Sequence; identical to SEQ ID NO: 6323
  Description of Artificial Sequence: Synthetic polypeptide

SEQ ID NO: 6432 - protein, 117 aa, Artificial Sequence; identical to SEQ ID NO: 6323
  Description of Artificial Sequence: Synthetic polypeptide

SEQ ID NO: 6433 - protein, 120 aa, Artificial Sequence
  Description of Artificial Sequence: Synthetic polypeptide
QVQLQQSGPELVKPGASVKISCKASGHTFTSYDINWVKQRPGQGLEWIGWIYPGDGSTKYNEKFKGKATLTADKSSSTAYMQLSSLTSENSAVYFCARRDYGYSYAMDYWGQGTSVTVSS

SEQ ID NO: 6434 - protein, 131 aa, Artificial Sequence
  Description of Artificial Sequence: Synthetic polypeptide
EVQLLESGPGLVKPSQTLSLTCAVSGAFMTSDYLYWSWLRQPPGKGPEWIGGIYTTGRSHYNPSLRGRATLSVDTSKNQFSLELNSVTAADTAVYYCARGQYHNWGPSLFDYYNYYYMDVWGKGTTVTVSS

SEQ ID NO: 6435 - protein, 432 aa, Artificial Sequence
  Description of Artificial Sequence: Synthetic polypeptide
EVQLVESGGGLVQPGGSLRVSCEVSGFTFSNNWMHWVRQAPGKGPVWVSRISTDGMSTSYAEFVKGRFTISRDNARNTLYLQMNSLRDEDTAVYYCVRGSTYYFGSGSLNFWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSV

SEQ ID NO: 6436 - protein, 232 aa, Artificial Sequence
  Description of Artificial Sequence: Synthetic polypeptide
LESGPGLVRPSETLSLTCSVSGGSITGSSYYWGWLRQTPGKGLEWIGSIYSTSGTTYYNPALESRVTMSVDTSQNRISMRLRSVTAADTAMYYCARPTAHRNVRMVPGQDAFEVWGRGTLVTVSAASTKGPSVFPLAPSSKSTSGGTAALGCLVKDYFPEPVTVSWNSGALTSGVHTFPAVLRSSGLYSLSSVVTVPSSSLGTQTYICNVNHKPSNTKVDKKVEPKSCDKTS

SEQ ID NO: 6437 - protein, 132 aa, Artificial Sequence
  Description of Artificial Sequence: Synthetic polypeptide
EVQLLEQSGAEVRKPGSSVKVSCKASGGTFSGHVITWVRQAPGQGLEWMGESIPIFGSANYAQNYAQKFRDRVSIIADESTSTSFIELSNLRSDDTAVYYCARDPPRYCSAGRCYPGFFQQWGQGTLVTVSS

SEQ ID NO: 6438 - protein, 127 aa, Artificial Sequence
  Description of Artificial Sequence: Synthetic polypeptide
EVQLLEQSGAEVKKPGSSVKVSCQVFGDTFSRYTIQWLRQAPGQGPEWMGNIIPVYNTPNYAQKFQGRLSITADDSTSTAYMELSSLRSEDTAVYFCARVVIPNAIRHTMGYYFDYWGQGTLVTVSS

SEQ ID NO: 6439 - protein, 128 aa, Artificial Sequence
  Description of Artificial Sequence: Synthetic polypeptide
EVQLLEQSGSSVKVSCKAHVISWVRQAMGGSISFFGFQGRVSITAYMELSSLRCAKDPPRFGFFQQWGQSCGAEVKKPGSGGTFSGPGQGLEWTSNSAQKDESASTAEDTAIYYSGGNCYPTLVTVSS

SEQ ID NO: 6440 - protein, 106 aa, Artificial Sequence
  Description of Artificial Sequence: Synthetic polypeptide
EVQLLESGGGVVQPGRSLRLSCAASGFTFKTYGMHWVRQAPGKGLEWVAGISFDGSNQYYADKGRFIVSRDNSRDTLQMSSLRLEDTAVYATEGSPFGENWGQGTL

SEQ ID NO: 6441 - protein, 132 aa, Artificial Sequence
  Description of Artificial Sequence: Synthetic polypeptide
EVQLLESGGGVVQPSLRLSCAASGFTFSGMHWVRQAPGKGLEAGIWFDGSNQYYSDSVVFYCYLGRAYWVSVKGRFTVSRDNSRNTLFLQMNSLRPEATEVLFGSNWGQGTLVITDTAVYYCKGRYYLEVSS

SEQ ID NO: 6442 - protein, 104 aa, Artificial Sequence
  Description of Artificial Sequence: Synthetic polypeptide
EVQLLESGPGTLSLTCTVSGHWWSWVRQPPLVKPSGGSIRSSGKGLEWIGEVFFSGSTIYNPSLNDRVFMSVDLRLSSVTAAARSPIKMNFDIWGQGTQLKDGV

SEQ ID NO: 6443 - protein, 126 aa, Artificial Sequence
  Description of Artificial Sequence: Synthetic polypeptide
EVQLLESGSEVKKPGSSVKVSCRASGGSFRSYNFNWVRQAPGQGLEWMGGIIPMFGTANYAQKFQGRVTITADESTATGYMELSSLRSEDTAVYYCAMPYPKHCSRGSCWGWFDPWGQGTLVTVSS

SEQ ID NO: 6444 - protein, 107 aa, Artificial Sequence
  Description of Artificial Sequence: Synthetic polypeptide
DIQMTQSPSTLSASIGDRVTITCRASLNILTWLAWYQQKPGKAPKLLIYEASSLESGVPSRFSGSGSGTQFTLTISSLQPDDFATYYCQQSNTPWTFGQGTKVEIKR

SEQ ID NO: 6445 - protein, 119 aa, Artificial Sequence
  Description of Artificial Sequence: Synthetic polypeptide
LLEQSGAEVKMPGATVKVSCQSSRYTFTSYGIGWVRQAPGQGLEWMGWISGYTHETKYAQSFQGRVTMTAETSTGTAYMELRSLRSDDTATYYCARDGGGRVVVPPTHLRAFDVWGQGT

SEQ ID NO: 6446 - protein, 124 aa, Artificial Sequence
  Description of Artificial Sequence: Synthetic polypeptide
LLESGPGLVKPSQTLSLTCTVSGVSISYGGRGVSYWGWVRQSPGKGLEWIGHIYYFGDTFYNPSLNNRATISIDSSKNQFSLKLKSVTASDTALYFCARSTLQYFDWLLTREAAYSIDFWGQGI

SEQ ID NO: 6447 - protein, 116 aa, Artificial Sequence
  Description of Artificial Sequence: Synthetic polypeptide
LLEQSGAEVKKPGSSVKVSCKASGDHYGINWVRQAPGQGLEWMGGIIPVFGTTTYAQKFQGRATITADDSTGTAFLELTRLTFDDTAVYFCATPHQLHVLRGGKALSPWDYWGQGT

SEQ ID NO: 6448 - protein, 120 aa, Artificial Sequence
  Description of Artificial Sequence: Synthetic polypeptide
LLEQSGSEVKVPGSSLKVSCKTSGGTFSTYTFSWVRQAPGQGLEWMGGITPIIGIANYARNFQDRVTITADESTSTVYMEVRRLRSEDTAVYYCAKTSEVTATRGRTFFYSAMDVWGQGT

SEQ ID NO: 6449 - protein, 118 aa, Artificial Sequence
  Description of Artificial Sequence: Synthetic polypeptide
LLEQSGSEVKKPGSSVRVSCTTSGGTLSDYGFNWLRQAPGQGPEWMGGIIPLFRRTTYGQKFQGRLTITADESTGATYMELSSLRSDDTAVYYCAREKVSVLTGGKSLHYFEYWGKGT

SEQ ID NO: 6450 - protein, 118 aa, Artificial Sequence
  Description of Artificial Sequence: Synthetic polypeptide
LLEESGAEVKKPGSSVKVSCKTSGDTFRYGITWVRQAPGQGLEWMGQIMPTFATATYAQRFQGRVTISADESTSTAYLEVRSLRSEDTAVYYCATPRQVTILRGPKALSPWDYWGQGT

SEQ ID NO: 6451 - protein, 127 aa, Artificial Sequence
  Description of Artificial Sequence: Synthetic polypeptide
QVQLVESGGGVVQPGRSLRLSCVASGFTFSHYAMHWIRQAPGKGLEWVAVVSYDGSNKFYVDSVKGRFTISRDNSKNTVYLQMNSLRAVDTAVYYCARDPGVVTGSWSDSDGPPIHWGQGTLVTVSS

SEQ ID NO: 6452 - protein, 104 aa, Artificial Sequence
  Description of Artificial Sequence: Synthetic polypeptide
AELVRPGGSVKLSCKASGYSFTTYWMNWVKQRPGQGLEWIGMIQPSDSETRLNQKFKDKATLTLDRSSSTVYMQLSSPTSDDSAVYYCARTGRGDAWLTYWGQG

SEQ ID NO: 6453 - protein, 101 aa, Artificial Sequence
  Description of Artificial Sequence: Synthetic polypeptide
AELVKPGASVKLSCTASGFNIKDTYMHWIKQRPEQGLEWIGRIAYADGNIKIDPKFQGKATITTVTSSNTAYLQLSSLTSEDTAVYYCAYYGLLFAYWGQG

SEQ ID NO: 6454 - protein, 240 aa, Artificial Sequence
  Description of Artificial Sequence: Synthetic polypeptide
MELVWTSFPLCLYSVIFFLMAVVTGVNSEVLLQQSGSDLVRPGALVNLSCKASGFNVQDFYIHWVKQRPEQGLEWIGWIDPDIGHTIYDPKFQGKASLAVDTSSNTAYLQLSSLTSEDTAVYYCARGLLTFFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVD

SEQ ID NO: 6455 - protein, 227 aa, Artificial Sequence
  Description of Artificial Sequence: Synthetic polypeptide
KRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQNNYKTTPPVLDSDGFLYSKLTVDKSRWQNVFSCSVMHEALHNTQKSLSLSPGK

SEQ ID NO: 6456 - protein, 117 aa, Artificial Sequence
  Description of Artificial Sequence: Synthetic polypeptide
EVQLVQSGAEVKKPGATVKISCKVSGFNVQDFYIHWVKQAPGKGLEWIGWIDPDIGHTIYDPKFQGKATITVDTSTDTAYMELSSLRSEDTAVYYCARGLLTFFDVWGQGTLVTVSS

SEQ ID NO: 6457 - protein, 135 aa, Artificial Sequence
  Description of Artificial Sequence: Synthetic polypeptide
STDTAYTAVYYCWGQGTLQVQLVQSGAEVKKPGASVKVSCKASGFNVQDFYIHWVRQAPGQGLEWIGWIDPDIGHTIYDPKFQGKATLTVDESTSTAYMELSSLRSEDTAVYYCARGLLTFFDVWGQGTLVTVSS

SEQ ID NO: 6458 - protein, 117 aa, Artificial Sequence
  Description of Artificial Sequence: Synthetic polypeptide
EVLLQQSGSDLVRPGALVNLSCKASGFNVQDFYIHWVKQRPEQGLEWIGWIDPDIGHTIYDPKFQGKASLAVDTSSNTAYLQLSSLTSEDTAVYYCARGLLTFFDVWGAGTTVTVSS

SEQ ID NO: 6459 - protein, 224 aa, Artificial Sequence
  Description of Artificial Sequence: Synthetic polypeptide
EVQLLEQSGPSLVKPSQTLSLTCSVTGDSITSGYWNWIRKFPGNKLEYMGYISYSGSTYYNLSLRSRISITRDTSKNQYYLQLNSVTTEDTATYYCALITTTTYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 6460 - protein, 149 aa, Artificial Sequence
  Description of Artificial Sequence: Synthetic polypeptide
AMEVQLLEQSGAEVKKPGSSVKVSCQVFGDTFSRYTIQWLRQAPGQGPEWMGNIIPVYNTPNYAQKFQGRLSITADDSTSTAYMELSSLRSEDTAVYFCARVVIPNAIRHTMGYYFDYWGQGTLVTVSSGTGGSGGGGSGGGGSGGGAS

SEQ ID NO: 6461 - protein, 233 aa, Artificial Sequence
  Description of Artificial Sequence: Synthetic polypeptide
EVQLLEQSGAEVKKPGSSVKVSCETSGGTFDNYALNWVRQAPGQGLEWIGGVVPLFGTTRNAQKFQGRVTISDDKSTGTGHMELRSLRSEDTAVYYCVRSVTPRYCGGGFCYGEFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGS

SEQ ID NO: 6462 - protein, 226 aa, Artificial Sequence
  Description of Artificial Sequence: Synthetic polypeptide
EVQLQESGPGLVKPSETLSLTCTVSGDSITSGYWNWIRQPPGRALEWMGYISYSGSTYYSLSLRSRITISRDTSKNQYSLRLSSVTAADTAMYYCALITTSTYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 6463 - protein, 226 aa, Artificial Sequence
  Description of Artificial Sequence: Synthetic polypeptide
EVQLLESGGGVVQPGRSLRLSCTASGFTFNNYGMHWVRQTPGKGLEWLAVIWFDENNKYYADSVRGRFTISRDNSKNTLFLQMNSLKTEDTAMYYCARDISLVRDAFIYFDFWGLGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 6464 - protein, 226 aa, Artificial Sequence; identical to SEQ ID NO: 6463
  Description of Artificial Sequence: Synthetic polypeptide

SEQ ID NO: 6465 - protein, 157 aa, Artificial Sequence
  Description of Artificial Sequence: Synthetic polypeptide
MEWSWVILFLLSLTAGVDAQGQMQQSGPELVKPGASVKLSCKTTDFTFNRNYISWLRQKPGQSLEWIAWIYAGTGGTKYNQKFTGKAQMTVDTSSHTAYMQFSNLTTEDSAVYYCARYLFDGYYIPLFDYWGQGTTLTVSSAKTTPPPVYPLAPGSL

SEQ ID NO: 6466 - protein, 127 aa, Artificial Sequence
  Description of Artificial Sequence: Synthetic polypeptide
EVQLQASGGGLVQPGGSLRLSCTASGFTDDYYAIGWFRQAPGKEREGVSCITNFDGGTYYADSVKSRFTMSRDNAKNTVYLQMNSLKPEDTAVYYCAADKGLCSWLRAGGKVTFGSWGQGTQVTVSS

SEQ ID NO: 6467 - protein, 129 aa, Artificial Sequence
  Description of Artificial Sequence: Synthetic polypeptide
EVQLQAGGGLAQPGGSLRLSCEASGFSLVNLDTIGWFRQAPGKEREGVSCVSESDGKEYYTDSVKGRFTISRDNAKNTMYLQMDSLNAEDTAVYYCVADSFAQCQPPYSGWNEDEYDYWGQGTQVTVSS

SEQ ID NO: 6468 - protein, 126 aa, Artificial Sequence
  Description of Artificial Sequence: Synthetic polypeptide
EEQLQASGGGLVQAGGSLRLSCTASERALSGLSVGWFRQAPGKERELVAALHRDGDMMYYADFEMGRFTISRDNAKNTVNLLMNSLKPEDTAVYYCAASTQKYYEDLRLLRDYDYWGQGTQVTVSS

SEQ ID NO: 6469 - protein, 123 aa, Artificial Sequence
  Description of Artificial Sequence: Synthetic polypeptide
EVQLQASGGGLVQVGGSLRLSCVARSPSTLAIGWFRQAPGKEREFVAAISWSGGTTHYANSAKGRFTISRDNAKNTIYLQMNMLKPEDTAVYYCAADRFGSGAALTRRVADDWGQGIQVTVSS

SEQ ID NO: 6470 - protein, 217 aa, Artificial Sequence
  Description of Artificial Sequence: Synthetic polypeptide
QSALTQPRSVSGSPGQSVTISCTGTNSDIGNYDYVSWYQQHPGKAPRLIIYDVSERPSGVPNRFSGSKSGNTASLTISGLQAEDESDYFCSSYAGTFTYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 6471 - protein, 110 aa, Artificial Sequence
  Description of Artificial Sequence: Synthetic polypeptide
DIQMTQSPLSLPVTPGEPASISCRSSQSLLYSNGYNYLDWYVQKPGQSPQLLIYVGSNRASGVPDRFSGRGSGTDFTLKISRVEAEDVGVYYCMQALQPPYTFDQGTKLE

SEQ ID NO: 6472 - protein, 107 aa, Artificial Sequence
  Description of Artificial Sequence: Synthetic polypeptide
DIQMTQSPASLSTSVGETVTITCRASGNIHNYLAWYQQKQGKSPQLLVYNAKTLADGVPSRFSGSGSGTQFSLKINSLQPEDFGSYYCQHFWSTPFTFGSGTKLEIK

SEQ ID NO: 6473 - protein, 109 aa, Artificial Sequence
  Description of Artificial Sequence: Synthetic polypeptide
AAELTQSPSSLSASVGDRVTITCRASQDISNYLAWYQQKPGKAPKLLIYSASRLQSGVPSRFSGSGSGTDYTLTLSSLHPEDSATYYCHQYHSAPWTFGQGTKVEIKRT

SEQ ID NO: 6474 - protein, 134 aa, Artificial Sequence
  Description of Artificial Sequence: Synthetic polypeptide
MDSQAQVLMLLLLWVSGTCGDIVMSQSPSSLAVSVGEKVTMSCKSSQSLLYSSIQKNYLAWYQQKPGQSPKLLIYWASTRESGVPDRFTGSGSETDFTLTISNVKAEDLAVYYCQQQYYNYPSTGGGTYLEIKR

SEQ ID NO: 6475 - protein, 108 aa, Artificial Sequence
  Description of Artificial Sequence: Synthetic polypeptide
DIQMTQSPASLSASVGETVTITCRASENIYSYLAWYHQKQGKSPQLLVYIAKTLAEGVPSRFSGSGSGTQFSLKIDSLQPEDVGSYYCQHHYGTPYTFGGGTKLEIKR

SEQ ID NO: 6476 - protein, 107 aa, Artificial Sequence
  Description of Artificial Sequence: Synthetic polypeptide
QAGLTQPPSVSVAPGKTARITCGGDNIGRKSVHWYQQKTGQAPVLVVYEDNKRPSGIPERFSGSNSGNTATLTISGTQAMDEADYYCQAWDSSTVVFGGGTKLTVLG

SEQ ID NO: 6477 - protein, 108 aa, Artificial Sequence
  Description of Artificial Sequence: Synthetic polypeptide
EIVLTQSPPSLSASVGDRVTITCQASQDINNNVNWFQQEPGKAPRLLIYDASNLQTGVPSRFSGSGSGTEFTLTISSLQPEDFATYYCQQTSVYPLTFGGGTKVDIKR

SEQ ID NO: 6478 - protein, 114 aa, Artificial Sequence
  Description of Artificial Sequence: Synthetic polypeptide
DIVMTQTPLSLPVTPGEPASISCRSSQSLLHSNGYNYLDWYLQKPGQSPQLLIYLGSKRASGVPDRFSGSGSGTDFTLQISRVEAEDVGVYYCMQSTQFPPYTFGQGTKLEIKR

SEQ ID NO: 6479 - protein, 109 aa, Artificial Sequence
  Description of Artificial Sequence: Synthetic polypeptide
QAVVTQEPSLTVSPGGTVTLTCRSSTGAITTNNFANWFQQKPGQAFRGLIGDTNNRVPGVPARFSGSLLGNKAALTITGAQPEDEAEYYCALWYNNWVFGGGTKLTVLG

SEQ ID NO: 6480 - protein, 109 aa, Artificial Sequence
  Description of Artificial Sequence: Synthetic polypeptide
QAVVTQEPSLTVSPGGTVTLTCRSSTGAITTNNFANWFQQKPGQAFRGLIGDTNNRVPGVPARFSGSLIGDKAALTITGAQPEDEAEYYCALWYNNWVFGGGTKLTVLG

SEQ ID NO: 6481 - protein, 105 aa, Artificial Sequence
  Description of Artificial Sequence: Synthetic polypeptide
EMVMTQSPVTLSVSPGERATLSCRASQSVSSNLAWYQQKPGQPPRLIIYGASTRATDVPARFSGSGSGTEFTLSISSLQSEDFAVYYCQQYHTWPFTFGPGTKVD

SEQ ID NO: 6482 - protein, 107 aa, Artificial Sequence
  Description of Artificial Sequence: Synthetic polypeptide
DIQMTQSPFFLSASVGDRVTITCRASQNIDTHLNWYQYKVGRAPTLLIYTTSSLQSGVPSRFSGSGSGTDFTLTISGLQPEDFATYYCQQSAASPRTFGPGTKVDIK

SEQ ID NO: 6483 - protein, 110 aa, Artificial Sequence
  Description of Artificial Sequence: Synthetic polypeptide
DIQMTQSPSTLSASIGDRVTITCRASQSISSWLPWLAWYQQKPGKAPRLLIYKASLLASGVPSRFSGSGSGTEFTLTISRLQPDDFATYYCQQYSAYPITFGPGTRVDIK

SEQ ID NO: 6484 - protein, 107 aa, Artificial Sequence
  Description of Artificial Sequence: Synthetic polypeptide
DIQMTQSPFLLSASVGDRVTITCRASQNIDTHLNWYQYKVGRAPTLLIYTTSTLQSGVPSRFSGSGSGTDFTLTISGLQPEDFATYYCQQSASSPRTFGPGTKVDIK

SEQ ID NO: 6485 - protein, 107 aa, Artificial Sequence
  Description of Artificial Sequence: Synthetic polypeptide
DIQMTQSPSTLSASVGDRVTITCRASQSVTTYLAWYQQKPGKAPKLLIYKASTLENGVPSRFSGGGSGTEFTLTIDSLQPDDFATYYCQQYNSFAFNFGQGTKVDIK

SEQ ID NO: 6486 - protein, 107 aa, Artificial Sequence
  Description of Artificial Sequence: Synthetic polypeptide
DIQMTQSPFFLSASVGDRVTITCRASQNIETHLNWYQHKLGKAPTLLIYSASSLQSGIPSRFSGSGSGTDFTLTISSLQPEDFATYYCQQSGASPRTFGPGTKVDIK

SEQ ID NO: 6487 - protein, 108 aa, Artificial Sequence
  Description of Artificial Sequence: Synthetic polypeptide
EIVLTQSPATLSLSPGERATLSCRASQSLSGYLAWYQQKPGQAPRLLIYSASNRATGIPARFSGSGSGTDFTLTISSLEPEDFAVYYCQQRSNWPMYTFGQGTKLEIK

SEQ ID NO: 6488 - protein, 109 aa, Artificial Sequence
  Description of Artificial Sequence: Synthetic polypeptide
EIVLTQSPPTLSLSPGERATLSCRASQSIGSYLAWYQQKPGQAPRLLIYHASNRATGIPARFSGSGSGTDFTLTINSLESEDSAVYYCQHRSNWPPLFTFGPGTKVDLK

SEQ ID NO: 6489 - protein, 107 aa, Artificial Sequence
  Description of Artificial Sequence: Synthetic polypeptide
DIQMTQSPSSLSASVGDRVTITCRASQTVSSYLSWYQQKPGKAPKLLIYGASTLQNGVPSRFSGSGSGTHFSLTIRGLQPEDFATYYCQQSYSTPPTFGQGTKVDFK

SEQ ID NO: 6490 - protein, 112 aa, Artificial Sequence
  Description of Artificial Sequence: Synthetic polypeptide
DIVVTQSPASLAVSLGQRATINCKSSQSVLYSSSSKNYIAWYQQKPGQPPRLLIYWASTRQSGVPARFSGSGSGTDFALTISSVQAEDVAVYYCQQYYGAPITFGQGTRLEI

SEQ ID NO: 6491 - protein, 108 aa, Artificial Sequence
  Description of Artificial Sequence: Synthetic polypeptide
DIQMTQSPSTLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKR

SEQ ID NO: 6492 - protein, 108 aa, Artificial Sequence
  Description of Artificial Sequence: Synthetic polypeptide
EIVLTQSPGTLSLSPGESATLSCRASQSVGRTYLAWYQQRPGRAPRLLIYGASTRATDIPDRFSGTGSGTDFTLTISRLEPEDFAVYFCHNYGTIPGTFGQGTKVDIK

SEQ ID NO: 6493 - protein, 110 aa, Artificial Sequence
  Description of Artificial Sequence: Synthetic polypeptide
QSVLTQPPSASGTPGQRVTMSCSGGSSNIGSNPVSWYQQLPGTAPRLLIYTNNERPSGVPDRFSASKSGTSASLAISGLQSEDEAHYYCASWDDSLKGVLFGGGTRLTVL

SEQ ID NO: 6494 - protein, 111 aa, Artificial Sequence
  Description of Artificial Sequence: Synthetic polypeptide
SLFLTQPPSVSATPGQRVTVSCSGSRSNIGNSFVSWYQQRLPGAAPKLLIYDNNKRPSGIPDRFSGSKSGTSATLVITGLQAGDEADYYCGTWDTTLSAGVFGGGTKLTVL

SEQ ID NO: 6495 - protein, 108 aa, Artificial Sequence
  Description of Artificial Sequence: Synthetic polypeptide
SYVLTQPPSVSVAPGQTARITCGGNNIGSKSVHWYQQKPGQAPVMVVYDDSDRPSGIPERFSGSNSGITATLTISRVEAGDEADYYCQVWDSSSDHVVFGGGTKLTVL

SEQ ID NO: 6496 - protein, 108 aa, Artificial Sequence
  Description of Artificial Sequence: Synthetic polypeptide
SYVLTQPTSVSVAPGQTARITCGGSDIGSKSVNWYQQKPGQAPVVVVYDDNERPSGVPERFSGSNSGNTATLTISRVEAGDEAEYYCQVWDTTTDHMIFGGGTKLTVL

SEQ ID NO: 6497 - protein, 108 aa, Artificial Sequence
  Description of Artificial Sequence: Synthetic polypeptide
SYVLTQPPSTSVAPGQTAKISCGGNNIGSESVNWYQQKSGQAPVLVVHDDNERPSGIPERFSGSNSGNTATLTISRVEAGDEADYYCQVCHSSNNHVIFGGGTKLTVL

SEQ ID NO: 6498 - protein, 111 aa, Artificial Sequence
  Description of Artificial Sequence: Synthetic polypeptide
SYVLTQPPSASVAPGQTARITCGGNNIGSLSVNWYQQKSGQAPVMVIDDDNDRPSGIPERFSGSNSGNTATLIISRVEAGDEADYYCQVWDGISNRVVFGGGTKLTVLGQP

SEQ ID NO: 6499 - protein, 112 aa, Artificial Sequence
  Description of Artificial Sequence: Synthetic polypeptide
QSVVTQPPSVSGAPGQRVTISCTGSSSNIGAGFDVHWYQQVLGTAPKLLIYGNNNRPSGVPDRFSGSKSGISASLTISGLQAEDEADYYCQSYDNSLSGHNYVFGTGTKVTV

SEQ ID NO: 6500 - protein, 112 aa, Artificial Sequence
  Description of Artificial Sequence: Synthetic polypeptide
QSALTQPASVSGSPGQSISISCTGARTDIGTYIHVSWHQQHPGKAPKLILFDVSNRPSGVSSRFSGSMSGNTASLTISGLQAEDEADYYCASFTPRYTWVFGGGTKLTVLGQ

SEQ ID NO: 6501 - protein, 108 aa, Artificial Sequence
  Description of Artificial Sequence: Synthetic polypeptide
ELVMTQSPSSLSASVGDRVTITCRASQGIYNSIAWYQQKPGKAPKLLLYSTSTLLSGVPSRFSGSGSGTDYTLTITNLQPEDFATYYCQQYFVTPETFGQGTKVEIKR

SEQ ID NO: 6502 - protein, 108 aa, Artificial Sequence
  Description of Artificial Sequence: Synthetic polypeptide
QSQLTQPPSVSVAPGQTARITCGGDNIGSKSVNWFQQKPGQAPVLVVYDDNERPSGISERFSGSNSGNTATLTISRVEAGDEADYYCQVWDSSSDHVVFGGGTKLTVL

SEQ ID NO: 6503 - protein, 135 aa, Artificial Sequence
  Description of Artificial Sequence: Synthetic polypeptide
MDTRVPAQLLGLLNLWVPGSSGDVVVTQSPLSLPVTLGQPASISCRSSLSLVDSDGNTYLNWFLQRPGQSPRRLIYQLSSRDSGVPDRFSGSGSGTDFTLKISRVEAEDVGVYYCMQGTHWPITFGQPTRLEIKR

SEQ ID NO: 6504 - protein, 127 aa, Artificial Sequence
  Description of Artificial Sequence: Synthetic polypeptide
MRPVAQLLGLLLLWFPGSRCDIQMTQSPSSVSASVGDRVTVTCRASQGISSWLAWYQQKPGKAPKLLINAASSLQSGVPSRFIGSGSGTDFTLTITSLQAEDFATYCQQADSLPFTFGGGTKVDFKR

SEQ ID NO: 6505 - protein, 104 aa, Artificial Sequence
  Description of Artificial Sequence: Synthetic polypeptide
QSQLTQPASVSVSPGQTASITCSGDRLGDEFASWYQQKPGQSPILVIFEDNKPSGIPERFSGSNSGNTATLTISGTQAMDEAYYCLAWASSLWVFGGGTKLTVL

SEQ ID NO: 6506 - protein, 127 aa, Artificial Sequence
  Description of Artificial Sequence: Synthetic polypeptide
MGWSCIILFLVATATGVHSEIVLTQSPGSLSLSPGERATLSCRASQSVTSSFLAWYQQRPGQAPRLLIYHTSSRATGIPDRPSGSGSGTDFTLTISRLQPEDFAVYYCHQYAYSPRTFGQGTKVEIK

SEQ ID NO: 6507 - protein, 127 aa, Artificial Sequence
  Description of Artificial Sequence: Synthetic polypeptide
MGWSCIILFLVATATGVHSEIVLTQSPGTLSLSPGERVTLSCRASQSISSTYLAWYQQKPGQAPRLLIYGASSRATGIPDRFSGSGSGTDFTLTISRLEPEDLGVYYCQQYGSSLRFGQGTKLEIKR

SEQ ID NO: 6508 - protein, 104 aa, Artificial Sequence
  Description of Artificial Sequence: Synthetic polypeptide
TQSPSSLSASIGDRVTITCRAGQSIDDYLNWYQQKPGKAPMLLIYWASSLQSGVPSRFSGGGSGTDFTLTISSLQPEDFATYYCQQSYSTPFTFGQGTKVEIKR

SEQ ID NO: 6509 - protein, 104 aa, Artificial Sequence
  Description of Artificial Sequence: Synthetic polypeptide
TQSPSSLSASIGDRVTITCRAGQSIDDYLNWYQQKPGKAPMLLIYHASSLQSGVPSRFSGGGSGTDFTLTISSLQPEDFATYYCQQSYSTPFTFGQGTKVEIKR

SEQ ID NO: 6510 - protein, 109 aa, Artificial Sequence
  Description of Artificial Sequence: Synthetic polypeptide
SYVLTQPPSVSVAPGKTARISCGGNNIGTKNVHWYQQKPGQAPVLVVYADSDRPSGIPERFSGSNSGNTATLTISRVEVGDEADYYCQVWDSVSYHVVFGGGTTLTVLG

SEQ ID NO: 6511 - protein, 112 aa, Artificial Sequence
  Description of Artificial Sequence: Synthetic polypeptide
DIVMTQSPLSLSVTPGEPASISCRSSQSLLHRSGNNYLDWYLQKPGHSPQLLIYVGSNRASGVPDRFSGSGSGTEYTLKISRVEAEDVGVYYCMQALQTPRTFGQGTKLEIK

SEQ ID NO: 6512 - protein, 112 aa, Artificial Sequence
  Description of Artificial Sequence: Synthetic polypeptide
DIVMTQTPLSLSVTPGQPASISCKSSQSLLYSNGKTYLNWLLQKPGQPPQRLIYLVSNRDSGVPDRFSGSGSGTDFTLKISRVEAEDVGVYYCVQGTHFPQTFGGGTKVEIK

SEQ ID NO: 6513 - protein, 115 aa, Artificial Sequence
  Description of Artificial Sequence: Synthetic polypeptide
QVQLVQSGAEVKAPGASVKVSCKASGYTFTSAWMNWVRQAPGQGLEWMGRIYPSGGSTSYAQKFQGRVTMTADKSTSTVYMELSSLRSEDTAVYYCAREYRVARWGQGTLVTVSA

SEQ ID NO: 6514 - protein, 112 aa, Artificial Sequence
  Description of Artificial Sequence: Synthetic polypeptide
DILMTQTPLILSVTIGQPASISCKSSQSLLYSNGKTYLNWLLQRPGQSPKRLIYLVSKLDSGVPDRFTGSGSGTDFTLKIIRVEAEDLGVYYCVQGTHFPQTFGGGTKLEIK

SEQ ID NO: 6515 - protein, 100 aa, Artificial Sequence
  Description of Artificial Sequence: Synthetic polypeptide
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCMQSIQLP

SEQ ID NO: 6516 - protein, 112 aa, Artificial Sequence
  Description of Artificial Sequence: Synthetic polypeptide
DILMTQTPLSLSVTPGQPASISCKSSQSLLYSNGKTYLYWLLQKPGQSPKRLIYLVSKLDSGVPDRFSGSGSGTDFTLKISRVEAEDVGVYYCVQGTHFPQTFGGGTKVEIK

SEQ ID NO: 6517 - protein, 109 aa, Artificial Sequence
  Description of Artificial Sequence: Synthetic polypeptide
QAVVTQESALTTSPGETVTLTCRSSTGAITTNNFANWVQEKPDHLFTGLIGDTNNRVPGVPARFSGSLIGDKAALTITGAQTEDEAIYFCALWYNNWVFGGGTKLTVLG

SEQ ID NO: 6518 - protein, 112 aa, Artificial Sequence; identical to SEQ ID NO: 6511
  Description of Artificial Sequence: Synthetic polypeptide

SEQ ID NO: 6519 - protein, 109 aa, Artificial Sequence; identical to SEQ ID NO: 6510
  Description of Artificial Sequence: Synthetic polypeptide

SEQ ID NO: 6520 - protein, 111 aa, Artificial Sequence
  Description of Artificial Sequence: Synthetic polypeptide
QSALTQPRSVSGSPGQSVTISCTGTNSDIGNYDYVSWYQQHPGKAPRLIIYDVSERPSGVPNRFSGSKSGNTASLTISGLQAEDESDYFCSSYAGTFTYVVFGGGTKLTVL

SEQ ID NO: 6521 - protein, 108 aa, Artificial Sequence; identical to SEQ ID NO: 6501
  Description of Artificial Sequence: Synthetic polypeptide

SEQ ID NO: 6522 - protein, 108 aa, Artificial Sequence
  Description of Artificial Sequence: Synthetic polypeptide
SYVLTQPPSVSVAPGQTARMTCGGNNIGSESVHWFQQKPGQAPVLVVYDDSDRPSGIPERFSGSNSGNTATLTISRVEAGDEADYYCQVWDSSSDHAVFGGGTQLTVL

SEQ ID NO: 6523 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWITFGQGTRLEIK

SEQ ID NO: 6524 - protein, 106 aa, Artificial Sequence
  Description of Artificial Sequence: Synthetic polypeptide
EIVLTQSPATLSLSPGERATLSCRASQSVGSYLAWYQQKPGQAPRLLIYDASNRATGIPARFSGSGSGTDFTLTISSLEPEDFAVYYCQQRSNWVTFGQGTRLEIK

SEQ ID NO: 6525 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISTLEPEDFAVYYCQQRSNWVTFGQGTRLEIK

SEQ ID NO: 6526 - protein, 112 aa, Artificial Sequence
  Description of Artificial Sequence: Synthetic polypeptide
AELTQSPDSLAVSLGERATINCKSSQSVLYSSHNKNYLAWYQQKPGQPPKLLIYWASTRESGVPDRFSGSGSGTDFTLTISSLQAEDVAVYYCQQYFSTPLTFGGGTKVEIK

SEQ ID NO: 6527 - protein, 106 aa, Artificial Sequence
  Description of Artificial Sequence: Synthetic polypeptide
AELTQSPSSLSASVGDRVTITCQASPDISNYLNWYQQKPGKAPNLLIYGASSLQRGVPSRLSGSGSGTDFTLTIDSLQPEDFATYYCQQSYGSPHTFGQGTKVEIK

SEQ ID NO: 6528 - protein, 107 aa, Artificial Sequence
  Description of Artificial Sequence: Synthetic polypeptide
AELTQSPATLSVSPGERATLSCRASQSVNSNLAWYQQKPGQAPSLLIYGASTRATGIPARFSGSGSGTELTLTISSLQSEDFAVYYCQQYKNWPPWTFGQGTKVEIK

SEQ ID NO: 6529 - protein, 106 aa, Artificial Sequence
  Description of Artificial Sequence: Synthetic polypeptide
AELTQSPSSLSASIGDRVTITCRASQGISNYVAWYQQRPGKVPKLLIFGASALHSGVPSRFSGSGSGTDFTLTITSLQPEDVATYYCQKYRSAPLTFGPGTRVDLK

SEQ ID NO: 6530 - protein, 109 aa, Artificial Sequence
  Description of Artificial Sequence: Synthetic polypeptide
AELTQSPGTLSLSPGERATLSCRASQSVSSSYLAWYQQKAGQAPRLLIYGASRRATGIPVRFSGSGSGAEFTLTISSLQSEDSAVYYCQHYHNWPAMYTFGQGTKLEIK

SEQ ID NO: 6531 - protein, 112 aa, Artificial Sequence
  Description of Artificial Sequence: Synthetic polypeptide
AELTQSPDSLAMSLGERASINCKSSRSLLYSSNNKNYLAWYQQKSGHPPKLLIYWASTRESGVPDRFNGSGSGTDFTLTISSLQAEDVAVYFCQQYYSSPLTFGGGTKVEIK

SEQ ID NO: 6532 - protein, 107 aa, Artificial Sequence
  Description of Artificial Sequence: Synthetic polypeptide
AELTQSPSSLSASVGDRVTITCQASQDINYSLNWYQQKPGKPPKLLIYYASHSDTGVPSRFSGGGSGTRFTLTIYSLQPEDIATYYCQHFDHVPRYTFGPGTKVDLK

SEQ ID NO: 6533 - protein, 106 aa, Artificial Sequence
  Description of Artificial Sequence: Synthetic polypeptide
AELTQSPDTLSLSPGERATLSCRASQSVNNNYLAWYQQKPGQAPRLLIYGASSRATGIPDRFSGSGSETDFTLTISRLEPEDFAVYYCQQYDSSRTFGQGTKVEIK

SEQ ID NO: 6534 - protein, 110 aa, Artificial Sequence
  Description of Artificial Sequence: Synthetic polypeptide
AELTQSPLSLPVTPGEPASISCRSSQSLLHTNGYNYLDWYLQKPGQSPQLLIYLGSNRASGVPDRFSGSGSGTDFTLKISRVEAEDVGVYYCMQALQTLTFGGGTKVEIK

SEQ ID NO: 6535 - protein, 106 aa, Artificial Sequence
  Description of Artificial Sequence: Synthetic polypeptide
AELTQSPSSLSASIGDRVAISCQASQDIGNYLNWYQQKPGKAPRLLIYDASNLEAGVPSRFSGSGSGTDFTLTISTLQPEDFATFYCQQTDSTPYTFGQGTKLEIR

SEQ ID NO: 6536 - protein, 105 aa, Artificial Sequence
  Description of Artificial Sequence: Synthetic polypeptide
AELTQSPSSLSASVGDRVTITCRASQTVSSYLNWYQQKPGKAPKVLIYGISTLQSGVPSRFSGSGSETDFTLTISNLQPEDFAIYYCQQSYSSRTFGQGTKVEIK

SEQ ID NO: 6537 - protein, 109 aa, Artificial Sequence
  Description of Artificial Sequence: Synthetic polypeptide
AELTQSPSSVSASVRDRVTITCRASQGISTWLAWYQQKPGKAPKLLIYAASTLQSGVPSRFSGSGSGTDFTLTIGSLQPEDVATYYCQQANSFPPGALTFGGGTKVEVK

SEQ ID NO: 6538 - protein, 106 aa, Artificial Sequence
  Description of Artificial Sequence: Synthetic polypeptide
AELTQSPAFMSATPGDKVNISCKASQDIDDDMNWYQQKPGEAAIFIIQEATTLVPGIPPRFSGSGYGTDFTLTINNIESEDAAYYFCLQHDNFPLTFGQGTKVEIK

SEQ ID NO: 6539 - protein, 106 aa, Artificial Sequence; identical to SEQ ID NO: 6538
  Description of Artificial Sequence: Synthetic polypeptide

SEQ ID NO: 6540 - protein, 106 aa, Artificial Sequence
  Description of Artificial Sequence: Synthetic polypeptide
AELTQSPSFSSASVGDRVTITCRASHGISSHLAWFQHKPGKAPNLLIYAASTLQSGVPSRFSGSQSGTEFTLTITSLHPEDFATYYCQQLYTWPMGFGQGTRLEIT

SEQ ID NO: 6541 - protein, 106 aa, Artificial Sequence
  Description of Artificial Sequence: Synthetic polypeptide
AELTQSPSSLSASVGDRVTITCRSSQSISNSLHWFQQEPGKAPKLLIYAASTLQSGVPSRFSGSGSGTDFTLIITGLQPEDFATYYCQQSPRTPLTFGGGTKVEIR

SEQ ID NO: 6542 - protein, 106 aa, Artificial Sequence
  Description of Artificial Sequence: Synthetic polypeptide
AELTQSPSSLSAFTGDRVSITCRASQGIGNSLAWYQQKPGHVPKVLIYDASTLSSGAPSRFSGSGSGTDFTLTISGLQPEDVATYYCQKYKSAPLTFGGGTKVEIR

SEQ ID NO: 6543 - protein, 112 aa, Artificial Sequence
  Description of Artificial Sequence: Synthetic polypeptide
AELTQSPDSLAVSLGERATINCKSSQSVLSSSNNKNYLAWYQQKPRQPPKLLIYWASTRESGVPDRFSGSGSGTDFTLTISSLQAEDVAVYYCQQFYSTPPTFGGGTKVEIR

SEQ ID NO: 6544 - protein, 106 aa, Artificial Sequence
  Description of Artificial Sequence: Synthetic polypeptide
AELTQSPSSLSASVGDRVTITCRASQSINTYLNWYQQKPGKAPELLIYGASSLQSGVPSRFSGSGSGTDFTLTITSLQAEDFASYFCQQSDSTPRTFGQGTKVEIK

SEQ ID NO: 6545 - protein, 106 aa, Artificial Sequence; identical to SEQ ID NO: 6538
  Description of Artificial Sequence: Synthetic polypeptide

SEQ ID NO: 6546 - protein, 105 aa, Artificial Sequence
  Description of Artificial Sequence: Synthetic polypeptide
AELTQSPSSLSASVGDRVTIACRASQSISNHLNWYQQKPGKAPKVLIYAASSLQSGVPSRFSGSGSGTDFTLTISSLQPEDFAIYYCQQSYSNADFGPGTKVDIK

SEQ ID NO: 6547 - protein, 106 aa, Artificial Sequence
  Description of Artificial Sequence: Synthetic polypeptide
AELTQSPSSLSASVGDGVTITCRASQSISTYLNWYQQKPGKAPKLLMYAASTLQSGVPSRFSGSGSGTDFTLTISSLQPEDFAAYYCQQARSFPYTFGQGTRLEIR

SEQ ID NO: 6548 - protein, 106 aa, Artificial Sequence; identical to SEQ ID NO: 6538
  Description of Artificial Sequence: Synthetic polypeptide

SEQ ID NO: 6549 - protein, 111 aa, Artificial Sequence
  Description of Artificial Sequence: Synthetic polypeptide
AELTQSPLSLAVTPGEPASISCRTSQSLLHSNGYTYLDWYLQKPGQSPQLLIYLASNRASGVPDRFSGSGSGTDFTLEISRVEAEDVGVYYCMQPLQTPVTFGQGTKVEVK

SEQ ID NO: 6550 - protein, 106 aa, Artificial Sequence; identical to SEQ ID NO: 6538
  Description of Artificial Sequence: Synthetic polypeptide

SEQ ID NO: 6551 - protein, 107 aa, Artificial Sequence
  Description of Artificial Sequence: Synthetic polypeptide
AELTQSPGTLSLSPGERGTLSCRASQSVSSSYLAWYQQKAGQAPRLLIYGASSRATGIPDRFSGSGSGTDFTLTISRLEPEDFAVYYCQRYGTSPKTFGQGTKVEFK

SEQ ID NO: 6552 - protein, 110 aa, Artificial Sequence
  Description of Artificial Sequence: Synthetic polypeptide
AELTQSPLSLPVTPGEPASISCRSSQSLLHSDGYNYFDWYLQKPGQSPQLLIYLGSNRASGVPDRFSGSGSDTDFTLKISRVEAEDVGVYYCMQTLQTLTFGGGTKLEIK

SEQ ID NO: 6553 - protein, 106 aa, Artificial Sequence; identical to SEQ ID NO: 6544
  Description of Artificial Sequence: Synthetic polypeptide

SEQ ID NO: 6554 - protein, 112 aa, Artificial Sequence
  Description of Artificial Sequence: Synthetic polypeptide
LEESGGGLVKPGGSLRLSCVASGLTFSRYNMQWVRQAPGKGLEWVASISTSGVYIYYADSVTGRFTISRDNSKNSLYLQMNSLGAEDTAVYYCARDLTFLCGGDCLQPWGQG

SEQ ID NO: 6555 - protein, 108 aa, Artificial Sequence
  Description of Artificial Sequence: Synthetic polypeptide
SYELTQPPSVSVSPGQTARITCSGDALPKQYAYWYQQKPGQAPVLVIYKDNERPSGIPERFSGSRSGTTVTLTISGVQAEDEADYYCQSADSSGSSWVFGGGTKLTVL

SEQ ID NO: 6556 - protein, 117 aa, Artificial Sequence
  Description of Artificial Sequence: Synthetic polypeptide
QVQLQQWGAGLLKPSETLSLTCAVYGGSLSGYFWTWIRQSPGKGLEWIGESNYSGSTRYNPSLKSRVTISVDTSQNQFSLKLSSVTAADTAVYYCARGWAVDGMDVWGQGTTVTVSS

SEQ ID NO: 6557 - protein, 108 aa, Artificial Sequence
  Description of Artificial Sequence: Synthetic polypeptide
SSELTQPPSVSVSPGQTARITCSGDALPKQYAYWYQQKPGQAPVLVIYKDNERPSGIPERFSGSRSGTTVTLTISGVQAEDEADYYCQSADSSGSSWVFGGGTKLTVL

SEQ ID NO: 6558 - protein, 106 aa, Artificial Sequence; identical to SEQ ID NO: 6524
  Description of Artificial Sequence: Synthetic polypeptide

SEQ ID NO: 6559 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWVTFGQGTRLEIK

SEQ ID NO: 6560 - protein, 124 aa, Artificial Sequence
  Description of Artificial Sequence: Synthetic polypeptide
  MOD_RES (101)..(101): Any amino acid
SSYVLTQPPSVSVAPGKTARITCGGNNIGSKSVHWYQQKPGQAPVLVVYDDSDRPSGIPERFSGSNSGNTATLTISRVEAGDEADYYCQVWDSSSVVFGGXTKLTVLAAAGGPFESKPIPNPLL

SEQ ID NO: 6561 - protein, 124 aa, Artificial Sequence
  Description of Artificial Sequence: Synthetic polypeptide
ETTLTQSPGTLSLSPGERATLSCRASQSVSSNLAWYQQKPGQAPRLLIYGASTRATGIPDRFSGSGSGTDFTLTISRLEPDDFVVYYCQQYGSSPVTFGQGTRLEIKRAAAGGPFEGKPIPNPL

SEQ ID NO: 6562 - protein, 122 aa, Artificial Sequence
  Description of Artificial Sequence: Synthetic polypeptide
EIVLTQSPDSLAVSLGERATIHCKSSQSIFFSSNSKDYLAWYQQKPGQPPKLLIYWASTRDSGVPDRFSGSGSGTDFTLTITGLQADDAAVYYCQQFDTPQITFGGGTKLEIKRAAAGGPFE

SEQ ID NO: 6563 - protein, 124 aa, Artificial Sequence
  Description of Artificial Sequence: Synthetic polypeptide
  MOD_RES (117)..(117): Any amino acid
EMTLTQSPSSLSASVGDRVTITCRASQSISSWLAWYQQKPGKAPKLLIYDASNLETGVPSRFSGSGSGTDFTFTISSLQPEDIATYYCQQYDNLPRTFGQGTKVDIKRAAAGGPFEXKPIPNPL

SEQ ID NO: 6564 - protein, 125 aa, Artificial Sequence
  Description of Artificial Sequence: Synthetic polypeptide
  MOD_RES (117)..(117): Any amino acid
  MOD_RES (119)..(119): Any amino acid
EIVLTQSPGTVSLFPGDRVTLSCRASQRVPSSSLAWYQQKPGQAPRLLLYGASSRATGIPDRFSGRGSGTDFALSISRLEPEDFAVYYCQQYGSSLITFGQGTRLEIKRAAAGGPFXGXPIPNPL

SEQ ID NO: 6565 - protein, 120 aa, Artificial Sequence
  Description of Artificial Sequence: Synthetic polypeptide
DIQMTQSPATLSLSPGERATLSCRASQSVSSYLAWYQQKPGQAPRLLIYDASNRATGIPARFIAGGSGTDFTLTISSLEPEDFAVYYCQQYGSPQTFGQGTKLEIKRAAAGGPFEGKPIP

SEQ ID NO: 6566 - protein, 106 aa, Artificial Sequence
  Description of Artificial Sequence: Synthetic polypeptide
SYELTQPLSVSVALGQTARITCGGNNIGSKNVHWYQQKPGQAPVLVIYRDSNRPSGIPERFSGSNSGNTATLTISRAQAGDEADYYCQVWDSSTAVFGGGTMLTVL

SEQ ID NO: 6567 - protein, 106 aa, Artificial Sequence
  Description of Artificial Sequence: Synthetic polypeptide
SYVLTQPPSVSVAPGKTARITCGGNNIGSKSVHWYQQKPGQAPVLVVYDDSDRPSGIPERFSGSNSGNTATLTISRVEAGDEADYYCQVWDSSSVVFGGGTKLTVL

SEQ ID NO: 6568 - protein, 106 aa, Artificial Sequence
  Description of Artificial Sequence: Synthetic polypeptide
SYVLTQPPSVSVSPGQTARITCSGDKLGDKYASWYQQKPGQSPVLVIYQDNKRPSEIPARFSGSNSGNTATLTISGAQAMDEADYYCQAWDSNTGVFGTGTKLTVL

SEQ ID NO: 6569 - protein, 113 aa, Artificial Sequence
  Description of Artificial Sequence: Synthetic polypeptide
DIVMTQAAFSNPVTLGTSASISCRSSKSLLHSDGITYLYWFLQKPGQSPQLLIYQMPNVASGVPDRFSSSGSGTDFTLRISRVEAEDVGVYYCAQNLELPPTFGGGTKLEIRR

SEQ ID NO: 6570 - protein, 113 aa, Artificial Sequence
  Description of Artificial Sequence: Synthetic polypeptide
DVVMTQTPLTLSVTIGQPASISCKSSQSLLYSNGKNYLNWLFQRPGQSPKRLIYLVSKLDSGVPDRFTGSGSGTDFTLKISRVEAEDLGVYYCVQGTHFPYTFGGGTKLEIKR

SEQ ID NO: 6571 - protein, 113 aa, Artificial Sequence
  Description of Artificial Sequence: Synthetic polypeptide
DVLMTQTPLSLPVSLGDQASISCRSSQSIVYSNGNTYLEWYLQKPGQSPKLLIYKVSKRFSGVPDRFSGSGSGTDFTLKISRVEAEDLGVYYCFQGSHVPYTFGGGTKLEIKR

SEQ ID NO: 6572 - protein, 107 aa, Artificial Sequence
  Description of Artificial Sequence: Synthetic polypeptide
QIVLTPSPAIMSASPGEKVTITCSASSSVSYMHWFQQKPGTSPKLWIYNTSTLASGVPARFSGSGSGTSYSLTISRMEAEDAATYYCQQRSSYPYTFGGGTKLEIKR

SEQ ID NO: 6573 - protein, 108 aa, Artificial Sequence
  Description of Artificial Sequence: Synthetic polypeptide
DTVMTQSQKFMSTSVGDRVSITCKASQNVRTVVAWYQQKPGQSPKALIYLASNRHTGVPDRFTGSGSGTDFTLTISNVQSEDLADYFCLQHWNYPLTFGGGTKLEIKR

SEQ ID NO: 6574 - protein, 106 aa, Artificial Sequence
  Description of Artificial Sequence: Synthetic polypeptide
DILMTQSHKFMSTSIGDRVSVTCKASQDVGTAVAWYQQKPGQSPKLLIYWASTRHTGVPDRFTGSGSGTDFTLTFNNVQSEDLADYFCQQYSNFPLTFGSGTKLEI

SEQ ID NO: 6575 - protein, 107 aa, Artificial Sequence
  Description of Artificial Sequence: Synthetic polypeptide
DILMTQSHKFMSTSLGDRVCITCQASLNLGTPVVWFQQKPGQSPKLLIYRTATRHTGIPDRFTGSGSGTDFTLTITNVQSEDLADYFCEKDGYYPLTFGSGTKLEIK

SEQ ID NO: 6576 - protein, 148 aa, Artificial Sequence
  Description of Artificial Sequence: Synthetic polypeptide
MAWISLILSAISQAGVTQPGETVTTLTLLALSSGESALTTSCRSSTGAVTTSNYANWVQEKPDHLFIGLIGGTNNRVTGVPARFSGSLIGDKAALTITGAQTEDEAIYFCALWYSDHWVFGGGTKLTVLGQPKSSPSVTLFPPSSEEL

SEQ ID NO: 6577 - protein, 115 aa, Artificial Sequence [sequence omitted]

SEQ ID NO: 6578 - protein, 102 aa, Artificial Sequence
  Description of Artificial Sequence: Synthetic polypeptide
DVVMTQTPLSLPVSLGDQASISCRSSQNIVHRNGNTYLEWYLQKPGQSPKLLIYKVSNRFSGVPDRFSGSGSGTDFTLKISRVEAEDLGLYYCFQGSHFPPT

SEQ ID NO: 6579 - protein, 108 aa, Artificial Sequence; identical to SEQ ID NO: 6501
  Description of Artificial Sequence: Synthetic polypeptide

SEQ ID NO: 6580 - protein, 108 aa, Artificial Sequence
  Description of Artificial Sequence: Synthetic polypeptide
DIVVTQSPSSLSASVGDRVTITCRASQGIYNSIAWYQQKPGKAPKLLLYSTSTLLSGVPSRFSGSGSGTDYTLTITNLQPEDFATYYCQQYFVTPETFGQGTKLEIKR

SEQ ID NO: 6581 - protein, 107 aa, Artificial Sequence; identical to SEQ ID NO: 6476
  Description of Artificial Sequence: Synthetic polypeptide

SEQ ID NO: 6582 - protein, 108 aa, Artificial Sequence; identical to SEQ ID NO: 6477
  Description of Artificial Sequence: Synthetic polypeptide

SEQ ID NO: 6583 - protein, 114 aa, Artificial Sequence; identical to SEQ ID NO: 6478
  Description of Artificial Sequence: Synthetic polypeptide

SEQ ID NO: 6584 - protein, 147 aa, Artificial Sequence
  Description of Artificial Sequence: Synthetic polypeptide
DIVMTQSPDSLAVSLGERATINCKSSQSVLYTTKNKNHLAWYQQKPGQPPKLLIYWASTRESGVPDRFSGSGSGTDFSLTITNLQAEDVALYYCHQYYLFPLTFGGGTKVEIKRTVAAPSVFIFPPSDEQLKSGTASVVCLLNNFYP

SEQ ID NO: 6585 - protein, 218 aa, Artificial Sequence
  Description of Artificial Sequence: Synthetic polypeptide
DIQMTQSPSSLSASVGDRVTITCRASESVDNYGISFMNWFQQKPGKAPKLLIYSASNHASGVPSRFSGSGSGTDFTLTISSLQPEDFATYYCHQSKEAPYAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6586 - protein, 218 aa, Artificial Sequence
  Description of Artificial Sequence: Synthetic polypeptide
ELTLTQSPASLAVSLGQRATISCRASESVDGYGNSFLHWFQQKPGQPPKLLIYLASNLNSGVPARFSGSGSRTDFTLTIDPVEADDAATYYCQQNNVDPWTFGGGTKLEIKRAVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6587 - protein, 176 aa, Artificial Sequence
  Description of Artificial Sequence: Synthetic polypeptide
ELTQSPATLSVSPGERATLSCRASQSVSSNLAWYQQKPGQAPRLLIYGASTRATGIPARFSGSGSGTEFTLTISSLQSQDFAVYYCQQYNNWPQTFGQGTKLEIKRTVAAPSVFIFPPSDEQLKSGTASVVCLLNNFYPREAKVQWKVDNALQSGNSQESVTEQTARTAPTASAAP

SEQ ID NO: 6588 - protein, 100 aa, Artificial Sequence
  Description of Artificial Sequence: Synthetic polypeptide
AELTQSPGTLSLSPRATLSCRASQSVSSLAWYQQRPGQAPRLYGASSRATGIPDRFYCGWGENYLISGSGSGTDFTLTISRLEPEDFAVYYCTFGQGTKV

SEQ ID NO: 6589 - protein, 98 aa, Artificial Sequence
  Description of Artificial Sequence: Synthetic polypeptide
YGNSRWKAELTQSPATLSLSPGERATLSCRASQSVNKYLAWYQQKPGQAPRLLIYDASNRATGIPARFSGSGSGTDFTLTIDFAVYYCQQGGGTKVEI

SEQ ID NO: 6590 - protein, 119 aa, Artificial Sequence
  Description of Artificial Sequence: Synthetic polypeptide
AELTQSPGTLRATLSCGASQSNLEPESDWVTFSLSPGESVRSNYLAWYQQKPGQAPRLLIYGVSSRATGIPDRFSGSGSGTDFTLTISRLEPEDFAVYYCQQYGSSPRTFGQGTKLEIK

SEQ ID NO: 6591 - protein, 97 aa, Artificial Sequence
  Description of Artificial Sequence: Synthetic polypeptide
AELTQSPATLSVSPRASLSCRASQSVGNAWYQQKPGQAPRLLGGNTRATGTPDRFSGENLIYGSGSGTEFTLTISSLQSEDFAVYFCQHFGGGTKVE

SEQ ID NO: 6592 - protein, 113 aa, Artificial Sequence
  Description of Artificial Sequence: Synthetic polypeptide
AELTQSPGTLRATLSCRASQSTWPLTSLSVGENIYSGYLGWYQQKPGQPPRLLIYGASNRATGIPDRFSGSGSGTDFTLTISRLESEDFAVYYCQQYGSPPYTFGQGTKVEIK

SEQ ID NO: 6593 - protein, 86 aa, Artificial Sequence
  Description of Artificial Sequence: Synthetic polypeptide
AELTQSPSSLRVTITCRASQSAFVSISRGNDLNWYQQKPGTAPKVLIYAASSLQSGVPSGSGTDFTLTIDFATYYCQQFGQGTKVE

SEQ ID NO: 6594 - protein, 104 aa, Artificial Sequence
  Description of Artificial Sequence: Synthetic polypeptide
TYRFSGSSLQPETTPRTAELTQSPGTLSLSPGERATLSCRASQSLSSKLAWYQQKPGQAPRLFYDASSRATGIPDRFSSGSGTDFTLSEDFAVYYCFGQGTKVE

SEQ ID NO: 6595 - protein, 125 aa, Artificial Sequence
  Description of Artificial Sequence: Synthetic polypeptide
EVQLLESGPGLVKPSQTLSLTCTVSGASISSDSYYYNWIRQPAGKGLEWIGRIYTSGSTNYNPSLKGRLTISVDTSKNQFSLKLTSVTAADTAVYYCARTGRFLEWFPNYGMDVWGQGSTVIVSS

SEQ ID NO: 6596 - protein, 125 aa, Artificial Sequence
  Description of Artificial Sequence: Synthetic polypeptide
EVQLLEQSGAEVKKPGSAVKVSCKASGGNFNIDTISWLRQVPGQGLEWMGRIIPIVTMTNYAETFQGRVTITADRSTSTVYMELRSLRSEDTAVYYCARSISDTGLFRLDAFDSWGPGTRVIVSS

SEQ ID NO: 6597 - protein, 125 aa, Artificial Sequence
  Description of Artificial Sequence: Synthetic polypeptide
EVQLLEQSGAEVKKPGSSVKVSCTASGGTFTTHTINWVRQAPGNGLEWMGQIIPLVGMTNIAQQFEGRITIIADKATSTAYMELSSLGSEDTALYYCARSLATSGLFRVDAFDLWGQGTMVTVSS

SEQ ID NO: 6598 - protein, 125 aa, Artificial Sequence
  Description of Artificial Sequence: Synthetic polypeptide
EVQLLEQSGAEVKKPGSSVKVFCKASGGIFYISTINWVRQAPGQGLEWMGKIIPGVGMTNFAQKFQGRVTITADKSTNTVYLEVSSLRSEDTAVYYCATSRPDTGLFRKDAFDVWGQGTVVIVSS

SEQ ID NO: 6599 - protein, 117 aa, Artificial Sequence
  Description of Artificial Sequence: Synthetic polypeptide
EVQLLESGPGLVKPSETLSLTCTVSGGSLSGYYWTWIRQPPGKGLEWIGYMYWSGSTNYSPSLKSRLTLSADTSKNHLSLKLTSVTAADTAVYYCGRLSRTVTMIDNWGQGILVTSP

SEQ ID NO: 6600 - protein, 123 aa, Artificial Sequence
  Description of Artificial Sequence: Synthetic polypeptide
QVQLVESGGGVVQPGRSLRLSCATSGFPFSSYGMHWVRQAPGKGLEWVAVISYDGSNEHSIDSVKGRFTISRDNSKNRLYLQMKSLRAEDMAVYFCVRGAHRSSWSGKRFDYWGQGTLVTVSS

SEQ ID NO: 6601 - protein, 104 aa, Artificial Sequence
  Description of Artificial Sequence: Synthetic polypeptide
MAELTQSPGTLSLSPGERATLSCRASHRVNNNFLAWYQQKPGQAPRLLISGASTRATGIPDRFSGSGSGTDFTLTISRLEPDDFAVYYCQQYGDSPLYSFGQGT

SEQ ID NO: 6602 - protein, 102 aa, Artificial Sequence
  Description of Artificial Sequence: Synthetic polypeptide
MAELTQSPSFLSASVGDRVTITCRASQGVTILLAWYQQKPGKPPKALIYAASSLQSGVPSRFSGSGSDTDFTLTISSLQPEDSATYYCQQLNTYPWTFGQGT

SEQ ID NO: 6603 - protein, 102 aa, Artificial Sequence
  Description of Artificial Sequence: Synthetic polypeptide
MAELTQSPATLSVSPGERATLSCRASQSVSSNLAWYQQKRGQAPSLLIYGTSTRATGIPARFSGSGSGTEFTLTISSLQSEDFAVYYCQQYNDWPSTFGQGT

SEQ ID NO: 6604 - protein, 102 aa, Artificial Sequence
  Description of Artificial Sequence: Synthetic polypeptide
MAELTQSPSFLSASVGDRVTITCRASQGISNYLAWYQQKPGKAPKLLIYAASTLQSGVPSRFSGSGSWTEFTLTISRLQPEDFATYYCQHLNTYPWTFGQGT

SEQ ID NO: 6605 - protein, 102 aa, Artificial Sequence
  Description of Artificial Sequence: Synthetic polypeptide
MAELTQSPATLSVSPGERATLSCRASQSVSSRLAWYQQKRGQAPSLLIYDTSSRATGVPARFSASGSGTQFTLTISSLQSEDFALYYCQQYNDWPSTFGQGT

SEQ ID NO: 6606 - protein, 102 aa, Artificial Sequence
  Description of Artificial Sequence: Synthetic polypeptide
MAELTQSPATLSASPGERASLSCRASQSVSSNLAWYQQKPGQAPRLLISGASTRATGVPARFSGSGSGTEFTLTISSLQSEDFAVYYCQQYNNWPPHFGQGT

SEQ ID NO: 6607 - protein, 113 aa, Artificial Sequence
  Description of Artificial Sequence: Synthetic polypeptide
DIVVTQSPDSLAVSLGERATITCKSSQSVFYSSNNKNYLGWYQQKPGQPPKLLIYWASTRASGVPDRFSGSGSGTDFTLTISSLQAEDVAVYYCQQYYTSWAFGQGTKVEIKR

SEQ ID NO: 6608 - protein, 99 aa, Artificial Sequence
  Description of Artificial Sequence: Synthetic polypeptide
QKFMSTSVGDRVSITCKASQNVRTAVAWYQQKPGQSPKALIYLASNRHTGVPDRFTGSGSGTDFTLTISNVQSEDLAAYFCQQYLNYPRTRSEGGPSWN

SEQ ID NO: 6609 - protein, 94 aa, Artificial Sequence
  Description of Artificial Sequence: Synthetic polypeptide
PASLAVSLGQRATISYRASKSVSTSGYSYMHWNQQKPGQPPRLLIYLVSNLESGVPARFSGSGSGTDFTLNIHPVEEEDAATYYCQHIRELTRS

SEQ ID NO: 6610 - protein, 234 aa, Artificial Sequence
  Description of Artificial Sequence: Synthetic polypeptide
MAWISLILSLLALSSGAISQAGVTQESALTTSPGETVTLTCRSSTGAVTTSNYANWVQEKPDHLFIGLIGGTNNRVTGVPARFSGSLIGDKAALTITGAQTEDEAIYFCALWYSDHWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 6611 - protein, 109 aa, Artificial Sequence
  Description of Artificial Sequence: Synthetic polypeptide
QTVVTQEPSLTVSPGGTVTLTCRSSTGAVTTSNYANWVQQTPGQAPRTLIGGTNNRVTGVPARFSGSILGDKAALTITGAQADDEADYFCALWYSDHWVFGGGTKLTVL

SEQ ID NO: 6612 - protein, 109 aa, Artificial Sequence
  Description of Artificial Sequence: Synthetic polypeptide
QTVVTQEPSLTVSPGGTVTLTCRSSTGAVTTSNYANWVQQTPGQAPRGLIGGTNNRVTGVPARFSGSLLGDKAALTITGAQADDEADYFCALWYSDHWVFGGGTKLTVL

SEQ ID NO: 6613 - protein, 109 aa, Artificial Sequence
  Description of Artificial Sequence: Synthetic polypeptide
QAGVTQESALTTSPGETVTLTCRSSTGAVTTSNYANWVQEKPDHLFIGLIGGTNNRVTGVPARFSGSLIGDKAALTITGAQTEDEAIYFCALWYSDHWVFGGGTKLTVL

SEQ ID NO: 6614 - protein, 143 aa, Artificial Sequence
  Description of Artificial Sequence: Synthetic polypeptide
AELTQSPATLSLSPGERATLSCRASQSVNKYLAWYQQKPGQAPRLLIYDASNRATGIPARFSGSGSGTDFTLTISNLEPEDFAVYYCQQRSDWVTFGGGTKVEIKAAADDDDKAGWSHPQFEKGGGSGGGSGGGSWSHPQFEK

SEQ ID NO: 6615 - protein, 218 aa, Artificial Sequence
  Description of Artificial Sequence: Synthetic polypeptide
EIELTLTQPASASATPGQRVTISCSGSSSNIGGNTVNWYQHLPGAAPKLLIHNNDLRPSGVPDRFSGSKSGTSASLAVSGLQSEDEADYFCAAWDDGLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 6616 - protein, 214 aa, Artificial Sequence
  Description of Artificial Sequence: Synthetic polypeptide
EIELTQSPATLSVSPGERATLSCRASQSVSSNLAWYQQKPGQAPRLLIYGASTRATGIPARFSGSGSGTEFTLTVSRLEPEDSAVYFCQQYYRSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6617 - protein, 218 aa, Artificial Sequence
  Description of Artificial Sequence: Synthetic polypeptide
DIVLTQSPSSLSASVGDRVTITCRASESVDGYGYSFLHWFQQKPGKAPKLLIYLASNLNSGVPSRFSGSGSGTDFTLTISSLQPEDFATYYCQQNNVDPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6618 - protein, 213 aa, Artificial Sequence
  Description of Artificial Sequence: Synthetic polypeptide
ELTLTQSPATLSLSPGERATLSCRASQSVSSYLAWYQQKPGQAPRLLIYDASNRATGIPARFSGSGSGTDFTLTISSLEPEDFAVYYCQQRSNWITFGQGTRLEIKRTVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNRGEC

SEQ ID NO: 6619 - protein, 213 aa, Artificial Sequence; identical to SEQ ID NO: 6618
  Description of Artificial Sequence: Synthetic polypeptide

SEQ ID NO: 6620 - protein, 159 aa, Artificial Sequence
  Description of Artificial Sequence: Synthetic polypeptide
MRSPAQLLPGHSLDMRFQVQVLGLLLLWISGAQCDVQITQSPSYLAASPGETISINCRANKSIDKYLAWYQEKPGKTNKLLIYSGSTLQSGVPSKFSGSGSGTDFTLTISSLEPEDFAMYYCQQHNEYPLTFGAGTKLDLRRADAAPTVSIFPPSSKLG

SEQ ID NO: 6621 - protein, 125 aa, Artificial Sequence; identical to SEQ ID NO: 6595
  Description of Artificial Sequence: Synthetic polypeptide

SEQ ID NO: 6622 - protein, 237 aa, Artificial Sequence
  Description of Artificial Sequence: Synthetic polypeptide
EVQLLEQSGAEVKKPGSAVKVSCKASGGNFNIDTISWLRQVPGQGLEWMGRIIPIVTMTNYAETFQGRLTITADRSTSTVYMELRSLRSEDTAVYYCARSISDTGLFRLDAFEVQLLEQSGAEVKKPGSSVKVSCTASGGTFTTHTINWVRQAPGNGLEWMGQIIPLVGMTNIAQQFEGRITIIADKATSTAYMELSSLGSEDTALYYCARSLATSGLFRVDAFDLWGQGTMVTVSS

SEQ ID NO: 6623 - protein, 125 aa, Artificial Sequence
  Description of Artificial Sequence: Synthetic polypeptide
EVQLLEQSGAEVKKPGSSVKVFCKASGGIFYISTINWVRQAPQGGLEWMGKIIPGVGMTNFAQKFQGRVTITADKSTNTVYLEVSSLRSEDTAVYYCATSRPDTGLFRKDAFDVWGQGTVVIVSS

SEQ ID NO: 6624 - protein, 118 aa, Artificial Sequence
  Description of Artificial Sequence: Synthetic polypeptide
EVQLLESGPGLVKPSETLSLTCTVSGGSLSGYYWTWIRQPPGKGLEWIGYMYWSGSTNYSPSLKSRLTLSADTSKNHLSLKLTSVTAADTAVYYCGRLSRTVTMIDNWGQGILVTVSP

SEQ ID NO: 6625 - protein, 118 aa, Artificial Sequence; identical to SEQ ID NO: 6624
  Description of Artificial Sequence: Synthetic polypeptide

SEQ ID NO: 6626 - protein, 108 aa, Artificial Sequence
  Description of Artificial Sequence: Synthetic polypeptide
MAQVKLQESGPELEKPGASVKISCKASGYSFTGYNMKWVKQSNGKSLEWIGYIYPYNGGTGYNQKFKSKATLTVDKSSSTAYMQLSSLTSEDSAVYYCARLGLDYWGQ

SEQ ID NO: 6627 - protein, 103 aa, Artificial Sequence
  Description of Artificial Sequence: Synthetic polypeptide
TTMAASPGEKITITCSASSSISSNYLHWYQQKPGFSPKLLIYRTSNLASGIPARFSGSGSGTSYSLTIGTMEAEDVATYYCQQGSSIPRIFTFGAGTKLEIKR

SEQ ID NO: 6628 - protein, 222 aa, Artificial Sequence
  Description of Artificial Sequence: Synthetic polypeptide
QVTLKQSGAEVKKPGSSVKVSCTASGGTLRTYGVSWVRQAPGQGLEWLGRTIPLFGKTDYAQKFQGRVTITADKSMDTSFMELTSLTSEDTAVYYCARDLTTLTSYNWWDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 6629 - protein, 214 aa, Artificial Sequence
  Description of Artificial Sequence: Synthetic polypeptide
EIVLTQSPGTLSLSPGERATLSCRASQSVTSSQLAWYQQKPGQAPRLLISGASNRATGIPDRFSGSGSGTDFTLTISRLEPEDFAVYYCQQYGSSPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 6630 - protein, 222 aa, Artificial Sequence; identical to SEQ ID NO: 6628
  Description of Artificial Sequence: Synthetic polypeptide

SEQ ID NO: 6631 - protein, 214 aa, Artificial Sequence; identical to SEQ ID NO: 6629
  Description of Artificial Sequence: Synthetic polypeptide

SEQ ID NO: 6632 - protein, 469 aa, Artificial Sequence
  Description of Artificial Sequence: Synthetic polypeptide
MDFGLSLVFLVLILKGVQCDVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6633 - protein, 233 aa, Artificial Sequence
  Description of Artificial Sequence: Synthetic polypeptide
MAVLGLLFCLVTFPSCVLSQLVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 6634 - protein, 256 aa, Artificial Sequence
  Description of Artificial Sequence: Synthetic polypeptide
EVQLLESGGGVVQPGRSLRLSCAASGFIFSEYDMHWVRQAPGKGLQWVAVISVDGSDKHYADSVKGRFTISRDNSQNMLFLQMDSLRGDDTAVYYCARDGKSLNGYSGLIDYWGQGSLVTVSSGGGGSGGGGSGGGGSEIVLTQSPATLSLSPGERATLSCRASQSVSSSYLAWYQQKPGQAPRLLIYDASNRAAGIPSRFSGSGSGSDFTLTISSLAPEDFAVYFCQQRSSWPPLTFGGGTKVEIKRDYKDDDDK

SEQ ID NO: 6635 - protein, 243 aa, Artificial Sequence
  Description of Artificial Sequence: Synthetic polypeptide
MAQVQLVQSGAEVKKPGASVKVSCKASGYTFTGYYMHWVRQAPGQGLEWMGWINPNSGGTNYAQKFQGWVTMTRDTSISTAYMELSRLRSDDTAVYYCARSDGSLWGQGTLVTVSSGGGGSGGGGSGGSALSSELTQDPAVSVALGQTVRITCQGDSLRSYYASWYQQKPGQAPVLVIYGKNNRPSGIPDRFSGSSSGNTASLTITGAQAEDEADYYCNSRDSSGTQVVFGGGTKLTVLGAAA

SEQ ID NO: 6636 - protein, 248 aa, Artificial Sequence
  Description of Artificial Sequence: Synthetic polypeptide
MAQVQLVQSGAEVKKPGASVKVSCKASGYTFTSYYMHWVRQAPGQGLEWMGWINAGNGNTKYSQKFQGRVTITRDTSASTAYMELSSLRSEDTAVYYCARSSPVYGPQWGQGTLVTVSSGGGGSGGGGSGGSALQSALTQPASVSGSPGQSITISCTGTSSDVGGYNYVSWYQQHPGKAPKLMIYEVSNRPSGVSNRFSGSKSGNTASLTISGLQAEDEADYYCSSYTSSRITVFGGGTKLTVLGAAA

SEQ ID NO: 6637 - protein, 246 aa, Artificial Sequence
  Description of Artificial Sequence: Synthetic polypeptide
MAQVQLVQSGAEVKKPGASVKVSCKASGYTFTGYYMHWVRQAPGQGLEWMGWINPNSGGTNYAQKFQGWVTMTRDTSISTAYMELSRLRSEDTAVYYCARPFSEPVWGQGTLVTVSSGGGGSGGGGSGGSALQSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSALVFGGGTKLTVLGAAA

SEQ ID NO: 6638 - protein, 246 aa, Artificial Sequence
  Description of Artificial Sequence: Synthetic polypeptide
MAEVQLVESGGGSVQPGGSLRLSCAASGFTFSSYAMSWVRQAPGKGLEWVSAISGSGGSTYYADSVKGRFTISRDNSKNTLYLQMNSLRAEDTAVYYCARAKYTPLWGQGTLVTVSSGGGGSGGGGSGGSALQSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGLVFGGGTKLTVLGAAA

SEQ ID NO: 6639 - protein, 245 aa, Artificial Sequence
  Description of Artificial Sequence: Synthetic polypeptide
MAQVQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARVTTRFWGQGTLVTVSSGGGGSGGGGSGGSALQSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLLALVFGGGTKLTVLGAAA

SEQ ID NO: 6640 - protein, 244 aa, Artificial Sequence
  Description of Artificial Sequence: Synthetic polypeptide
MAQVQLQESGPGLVKPSETLSLTCAVSGYSISSGYYWGWIRQPPGKGLEWIGSIYHSGSTNYNPSLKSRVTISVDTSKNQFSLKLSSVTAADTAVYYCARMGIGNNPKWGQGTLVTVSSGGGGSGGGGSGGSALDIQLTQSPSSLPASVGDRVTITCRASQSISSYLNWYQQKPGKAPKLLIYAASSLQSGVPSRFSGSGSGTDFTLTISSLQPEDFATYYCQQSYSTHTFGQGTKLEIKRAAA

SEQ ID NO: 6641 - protein, 275 aa, Artificial Sequence
  Description of Artificial Sequence: Synthetic polypeptide
MKYLLPTAAAGLLLLAAQPAMAQVKLLESGPGLVKPSETLSLTCSVSGGSITTKDFSWAWIRQPPGKGLEWIGSIYYSGTTHYSPSLKSRVIMSVDTSDNKFSLSLTSVTAADTAVYYCARQLGRSPGIYSFWRDHRTSAFDFWGQGTLATVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTSDYKDDDDKHHHHHH

SEQ ID NO: 6642 - protein, 121 aa, Artificial Sequence
  Description of Artificial Sequence: Synthetic polypeptide
LESGAEVKKPGSSVKVSCKTSGGAFSSYAINWVRQAPGQGLEWMGGILPVFGTTNHAQKFQGRVTFTADASTSTAYMELSSLRSEDTAVYYCARVGYCSTNGCSLGGMDVWGQGTTVIVSS

SEQ ID NO: 6643 - protein, 122 aa, Artificial Sequence
  Description of Artificial Sequence: Synthetic polypeptide
LEQSGAEVKKPGSSVKVSCKASGGSFSSYAINWVRQAPGQGLEWMGGLMPIFGTTNYAQKFQDRLTITADVSTSTAYMQLTGLTYEDTAMYYCARVAYMLEPTVTAGGLDVWGQGTTVTVAS

SEQ ID NO: 6644 - protein, 119 aa, Artificial Sequence
  Description of Artificial Sequence: Synthetic polypeptide
LEESGAEMKKPGSSVRVSCKASGFTFHNHAVSWVRQAPGEGLEWMGGLIPIVGLANLQPRFQGRVTISADESTNTAYMEMRSLTSDDTAIYYCVRHGDDSSGFPPFDLWGQGALVIVSS

SEQ ID NO: 6645 - protein, 118 aa, Artificial Sequence
  Description of Artificial Sequence: Synthetic polypeptide
LEESGGGLVKPGGSLRLSCTASGFIFSDFYFSWIRQPPGKGLEWLSYIGGSHVYTNSADSVKGRFTTSRDNAQKSLYLQMNSLRAEDTAVYYCARHSPETDGDTFDYWGQGTLVIVPS

SEQ ID NO: 6646 - protein, 122 aa, Artificial Sequence
  Description of Artificial Sequence: Synthetic polypeptide
LEESGAEVKKPGSSVKVSCRASGGTFNNYAISWVRQAPGQGLEWMGGIFPFRNTAKYAQHFQGRVTITADESTGTAYMELSSLRSEDTAIYYCARGDTIFGVTMGYYAMDVWGQGTTVTVAS

SEQ ID NO: 6647 - protein, 120 aa, Artificial Sequence
  Description of Artificial Sequence: Synthetic polypeptide
LESGGGLVQPGGSLRLSCAASGFTFSGYAMNWVRQAPGKGLEWVSAISGNGFSTYYADSVKGRFTISRDNARNTLYLQMNSLRAEDTAVYYCAKVLLVATHYYYNGMDVWGQGTTVTVSS

SEQ ID NO: 6648 - protein, 125 aa, Artificial Sequence
  Description of Artificial Sequence: Synthetic polypeptide
VQLQESGGGVVQPGRSLRLSCAASGFTFSTYGMHWVRQAPGKGLEWVAVISYDGSSKYSADSVKGRFTISRDNFKNTVYLQMNSLRAEDTAVYYCAKDNYSKYGVVRVGYGMDVWGQGTTVTVSS

SEQ ID NO: 6649 - protein, 127 aa, Artificial Sequence
  Description of Artificial Sequence: Synthetic polypeptide
EVQLLESGGGLVQPGGSLRLSCAASGFSFSSVYDMSWVRQAPGKGLEWIASIVTGSRTTWYASWAKGRFTVSRDNSKNTLYLQMNSLRAEDTAVYFCARGEYGHDGYVDGTMGLGLWGPGTTVTVSS

SEQ ID NO: 6650 - protein, 127 aa, Artificial Sequence
  Description of Artificial Sequence: Synthetic polypeptide
EVQLLESGGGLVQPGGSLRLSCAASGFSFSSVYDMSWVRQAPGKGLEWIASIVTGSRTTWYASWAKGRFTVSRDTSKNTLYLQMNSLRAEDTAVYFCARGEYGHDGYVDGTMGLGLWGPGTTVTVSS

SEQ ID NO: 6651 - protein, 124 aa, Artificial Sequence
  Description of Artificial Sequence: Synthetic polypeptide
EVQLLESGGGLVQPGGSLRLSCAASGFSLSAYSVSWVRQAPGKGLEWIGIIGHSGNTYYASWAKGRFTISRDNSKNTVYLQMNSLRAEDTAVYFCAREDYRYGDYGYYWDFNFWGPGTLVTVSS

SEQ ID NO: 6652 - protein, 124 aa, Artificial Sequence
  Description of Artificial Sequence: Synthetic polypeptide
EVQLLESGGGLVQPGGSLRLSCAASGFSLSAYSVSWVRQAPGKGLEWIGIIGHSGNTYYASWAKGRFTISRDTSKNTVYLQMNSLRAEDTAVYFCAREDYRYGDYGYYWDFNFWGPGTLVTVSS

SEQ ID NO: 6653 - protein, 119 aa, Artificial Sequence
  Description of Artificial Sequence: Synthetic polypeptide
EVQLVESGGGLVQPGGSLRLSCAASGFDVSSYWMSWVRQAPGKGLEWIGYIDPVFGTTYYASWVNGRFTISSHNSKNTLYLQMNSLRAEDTAVYFCATNTHGTGGYYLWGPGTLVTVSS

SEQ ID NO: 6654 - protein, 126 aa, Artificial Sequence
  Description of Artificial Sequence: Synthetic polypeptide
EVQLLESGGGLVQPGGSLRLSCAASGFSFSGSYYMCWVRQAPGKGLEWIACIDGDLSGSAYYANWAKGRFTISRDNSKNTVYLQMNSLRAEDTAVYYCAREGPVGVGSIYLGFDLWGPGTLVTVSS

SEQ ID NO: 6655 - protein, 126 aa, Artificial Sequence
  Description of Artificial Sequence: Synthetic polypeptide
EVQLLESGGGLVQPGGSLRLSCAASGFSFSGSYYMCWVRQAPGKGLEWIACIDGDLSGSAYYANWAKGRFTISRDTSKNTVYLQMNSLRAEDTAVYYCAREGPVGVGSIYLGFDLWGPGTLVTVSS

SEQ ID NO: 6656 - protein, 138 aa, Artificial Sequence
  Description of Artificial Sequence: Synthetic polypeptide
MEWSWIFLFLLSGTAGVHSEVQLQQSGPELVKPGASVKMSCKASGYTFTSYVMHWVKQKPGQGLDWIGYIVPYNDGTKYNEKFKGKATLTSDKSSSTAYMELSRLTSEDSAVYYCVYGSRYDWYLDVWGAGTTVTVSS

SEQ ID NO: 6657 - protein, 163 aa, Artificial Sequence
  Description of Artificial Sequence: Synthetic polypeptide
MECSWVFLFLLSITAGVHCQVQLQQSGPELVKPGASVKISCTASGYTFSGSWMNWVKQRPGQGLEWIGRIYPGDGDTNYSGKFKGKATLTADKSSSTAYLQLSSLTSVDSAVYFCARDDGYYVAFDYYAMDYWGQGTSVTVSSAKTTPPSVYPLVPVCGGKLG

SEQ ID NO: 6658 - protein, 161 aa, Artificial Sequence
  Description of Artificial Sequence: Synthetic polypeptide
MEWTWVILFLLSVTEGVHSQVQLQQSGAELVRPGSSVKISCKASGYAFSGYWINWVKQRPGQGLEWIGQIYPGDGDTDYNGKFKGKATLTADKSSSTAYMQLSSLTSEDSAVYFCARGYDEVDYYFAMDYWGQGTSVTVSSAKTTPPSVYPLAPVCGDKLG

SEQ ID NO: 6659 - protein, 158 aa, Artificial Sequence
  Description of Artificial Sequence: Synthetic polypeptide
MKWSWVILFLVATATGVHSQVQLQQPGAELVRPGVSVKLSCKASGYTFTSYWMHWIKQRPEQGLERIGEINPSNGGTYYNEKFNRKATLTVDKSSSTAYMQLSSLTSEDSAVYYCARSDGYLWFFDVWGAGTKVTVSSATTTAPSVYPLVPVCGDKLG

SEQ ID NO: 6660 - protein, 130 aa, Artificial Sequence
  Description of Artificial Sequence: Synthetic polypeptide
QVQLVQSGAEVRKPGASVKVSCKASGYSLKDHYMVWVRQAPGQGLEWMGWINPQSGGTGYGQKFQGRVTMTRDTSTNTAYMILSSLRSDDTAVYFCARDGAKTVSNSGLSLLYYHNRLDAWGQGTMVTVS

SEQ ID NO: 6661 - protein, 126 aa, Artificial Sequence
  Description of Artificial Sequence: Synthetic polypeptide
QVQLVESGGGVVQPGRSVRLSCVASGFTFSSYAMHWVRQAPGKGLEWVSLISFDGDNKYYADSVRGRFTISRDSSQKTLFLQMNSLRVEDTAIYYCAREELVGLMPPYYNYGLDVWGQGTTVTVSS

SEQ ID NO: 6662 - protein, 124 aa, Artificial Sequence
  Description of Artificial Sequence: Synthetic polypeptide
QVQLVESGGGVVQPGRSLRLSCAASGFSFNTYGMHWVRQAPGKGLEWVAVIWDDGSKMYHADSVKGRFTISRDNSKNTLYLQMNSLRAEDTAVYYCARDEGAIMLHAMTDYGLDVWGQGTTVTV

SEQ ID NO: 6663 - protein, 127 aa, Artificial Sequence
  Description of Artificial Sequence: Synthetic polypeptide
QVQLVQSGAEVRKPGSSVKVSCKASGGTFSSYVIHWVRQAPGQGLEWMGGIIPIFNTANYAQKVQGRVTITADESTSTAYMELSSLRSEDTAIYYCARDFLSGPMEMPGGYYGLDVWGQGTTVTVSS

SEQ ID NO: 6664 - protein, 124 aa, Artificial Sequence
  Description of Artificial Sequence: Synthetic polypeptide
QVQLQQWGAGLLKPSETLSLTCAVYGGSFSGYYWGWIRQPPGKGLEWIGEINHSGSANSNPSLKSRVTMSVDTSKNQFSLKVSSVTAADTAVYFCARVTRDLEWIPGDYYMDVWGKGTTVTVSS

SEQ ID NO: 6665 - protein, 119 aa, Artificial Sequence
  Description of Artificial Sequence: Synthetic polypeptide
EVQLQQSGPELVKPGTSMKISCKASGSSFTDYTMNWMKQSHGKNLEWIGLINPYNGGTRYNQKFKGKATLTLDKSSSTAYMEVLSLTSEDSAVYYCAGGLRRVNWFAYWGQGTLVSVSA

SEQ ID NO: 6666 - protein, 120 aa, Artificial Sequence
  Description of Artificial Sequence: Synthetic polypeptide
DVQLVESGGGLVQPGGSRKLSCAASGFTFSSFGMHWVRQAPEKGLEWVAYISSGSSTLHYADTVKGRFTISRDNPKNTLFLQMTSLRSEDTAMYYCARWGNYPHYAMDYWGQGTSVTVSS

SEQ ID NO: 6667 - protein, 117 aa, Artificial Sequence
  Description of Artificial Sequence: Synthetic polypeptide
QVQLQQSQPELKKPGQTVRISCKASGYTFTTAGMQWVQKMPGKGLKWIGWINTHSGVPKYAEDFKGRFAFMLETSASTAYLQINNLKNEDTATYFCARNYGWYFDVWGQGTTVTVSS

SEQ ID NO: 6668 - protein, 121 aa, Artificial Sequence
  Description of Artificial Sequence: Synthetic polypeptide
RGAAGESGAEVKKTGSSVKVSCKASGYTFTYRYLHWVRQAPGQALEWMGWITPFNGNTNYAQKFQDRVTITRDRSMSTAYMELSSLRSEDTAMYYCARGADTAMAGAFDIWGQGTMVTVSS

SEQ ID NO: 6669 - protein, 124 aa, Artificial Sequence
  Description of Artificial Sequence: Synthetic polypeptide
MAQVTLKQSGAEVKKPGSSVKVSCTASGGTLRTYGVSWVRQAPGQGLEWLGRTIPLFGKTDYAQKFQGRVTITADKSMDTSFMELTSLTSEDTAVYYCARDLTTLTSYNWWDLWGQGTLVTVSS

SEQ ID NO: 6670 - protein, 124 aa, Artificial Sequence
  Description of Artificial Sequence: Synthetic polypeptide
MAQVQLQQSGAGVKKPGSSVRVSCSASGGTLRTYALSWVRQVPGQGFEWMGRIIPMFGKTDYAQKFQGRLSITADKSMDTGFMELTSLTSEDTAVYYCARDLTTLTSYNWLDIWGQGTLVTVSS

SEQ ID NO: 6671 - protein, 122 aa, Artificial Sequence
  Description of Artificial Sequence: Synthetic polypeptide
QVQLQQSGAEVKKPGSSVKVSCKASGGTLRTYGVSWVRQAPGQGLEWLGGTIPLFGKTDYAQKFQGRVTITADKSMDTSFMELTSLTSEDTAVYYCARDLTTLTSYNWWDLWGQGTLVTVSS

SEQ ID NO: 6672 - protein, 147 aa, Artificial Sequence
  Description of Artificial Sequence: Synthetic polypeptide
MDWTWRFLFVVAAATGVLSQVQLVQSGAEVKKPGSSVKVSCKASGGTFSNFAISWVRQAPGQGLEWMGRIMPLFVTSTYAQKFQGRVTISADASTSTAYMELSSLRSDDTAMYYCARDITAPGAAPTPLNFYGMDVWGQGTTVTVSS

SEQ ID NO: 6673 - protein, 240 aa, Artificial Sequence
  Description of Artificial Sequence: Synthetic polypeptide
MKYLLPTAAAGLLLLAAQPAMAELTQSPDSLAVSLGERATINCKSSQSVLYYSNKKNYLAWYQQKPGQPPKLLIYWASTRESGVPDRFSGSGSGTDFTLTISSLQAEDVAVYYCQQYYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6674 - protein, 454 aa, Artificial Sequence
  Description of Artificial Sequence: Synthetic polypeptide
QVQLQQWGAGLLKPSETLSLTCAVYGGSFSGYYWGWIRQPPGKGLEWIGEINHSGSANSNPSLKSRVTMSVDTSKNQFSLKVSSVTAADTAVYFCARVTRDLEWIPGDYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 6675 - protein, 125 aa, Artificial Sequence
  Description of Artificial Sequence: Synthetic polypeptide
QVRLVESGGGVVQPGGSLRLSCEGSGFKFGDHGIHWVRQAPGEGLQWLTVISSDGTDERYTDSVKGRFTISRDNSKNTMSLQMNNLRPEDMGLYYCARDGKCGGGRCYSGLLDYWGQGTMVTVSS

SEQ ID NO: 6676 - protein, 119 aa, Artificial Sequence
  Description of Artificial Sequence: Synthetic polypeptide
QIQLVQSGTELKKPGETVKISCKASGYTFTTYGVNWVKQAPGKGLKWMGWIINTYTGEPTYVDDFKGRFAFSLETSANTAYLQINNLKNADMATYFCARAQGFGYFDYWGQGTTLTVSS

SEQ ID NO: 6677 - protein, 117 aa, Artificial Sequence
  Description of Artificial Sequence: Synthetic polypeptide
QVQLQQPGAELVRPGASVKLSCKASGYTFTSYWMNWVKQRPGQGLEWIGMIIDPSDSETHYNQIFKDKATLTVDKSSSTAYMHLSSLTSEDSAVFYCARGRNDFAYWGQGTLVTVSA

SEQ ID NO: 6678 - protein, 120 aa, Artificial Sequence
  Description of Artificial Sequence: Synthetic polypeptide
EVQLQQSGPELVKPGASMKISCKASGYSFTGYTMNWVKQRHGKSIEWIGLIINPNNGGTSYNQRFRGKTTLTLDKSSSTVYMELLSLTSEDSAVYYCARRGFRDYALDSWGQGTSVTVSS

SEQ ID NO: 6679 - protein, 120 aa, Artificial Sequence
  Description of Artificial Sequence: Synthetic polypeptide
EVQLQQSGPELVKPGASMKISCKASVYSFTGYTMNWVKQSHGQNLEWIGLIINPYNGGTSYNQKFKGKATLTVDKSSNTAYMELLSLTSADSAVYYCTRRGFRDYSMDYWGQGTSVTVSS

SEQ ID NO: 6680 - protein, 93 aa, Artificial Sequence
  Description of Artificial Sequence: Synthetic polypeptide
VVSGAVKKGKSRSCKASGYRTSYYAWVRHMGKGWMGYGDSDTYSSGVTSADKSATTAYWSSRASDTAMYYCARSTSGDYVGADWGGTMVTVSS

SEQ ID NO: 6681 - protein, 205 aa, Artificial Sequence
  Description of Artificial Sequence: Synthetic polypeptide
NTTHYRASSGINAEYMGINICPMSSPQSLKTLTITMGWTWIFILILSVTTGVHSEVQLQQSGPELEKPGASVKISCKASGYSFTGYNMNWVKQSNGKRLEWIGNIDPYYGGASYNQKFKGKATLTVDKSSTTAYMQLQSLTSEDSAVYYCARGGYGRYFDVWGAGTAVTVSSAKTTPPSVYPLAPGCGDTTGSSVTLGCLVKGYF

SEQ ID NO: 6682 - protein, 122 aa, Artificial Sequence [sequence omitted]

SEQ ID NO: 6683 - protein, 131 aa, Artificial Sequence
  Description of Artificial Sequence: Synthetic polypeptide
MAWSPLLLTLLAHCTGSWAQSVLTQPPSVSGAPGEGVTLSCTGSRSNIGAGYDVHWYQHLPGTAPKLLIYGDNNRPSGVPDRFSGSKSGTSASLAITGLQAEDEADYYCQSYDSGLSGSIFGGGTKLTVLG

SEQ ID NO: 6684 - protein, 127 aa, Artificial Sequence
  Description of Artificial Sequence: Synthetic polypeptide
EVQLVESGGGVVQPGRSQRLSCAASGFTFRRYAIHWVRQAPGKGLEWVAVISNDGSNKFYAESVEGRFTVSRDNSMNTVYLQMNGLRAEDTAVYYCARAPEYCSGGSCYSQYYFDYWGRGTLVTVSS

SEQ ID NO: 6685 - protein, 120 aa, Artificial Sequence
  Description of Artificial Sequence: Synthetic polypeptide
EVQLVESGGGLVQPGGSLRLSCAASGFTFSDYWMSWVRQAPGKGLEWVANIKYDGSEKYYVDSVKGRFTTSRDNAKNSLYLQMNSLRAEDTAVYYCAGLLWFGEKAFDIWGQGTMVTVSS

SEQ ID NO: 6686 - protein, 127 aa, Artificial Sequence
  Description of Artificial Sequence: Synthetic polypeptide
EVQLVESGGGVVQPGRSLRLSCAASGFTFSRNGMHWVRQAPGKGLEWVAVIANDGGNNYYADSVKGRFTISRDNSKNTLYLQMNSLRAEDTAVYYCAKAGYYYDSGTYYSQYYFDYWGQGTLVTVSS

SEQ ID NO: 6687 - protein, 125 aa, Artificial Sequence
  Description of Artificial Sequence: Synthetic polypeptide
QVQLQESGSGLVKPSQTLSLTCAVSGGSISSGDYSWSWIRQPPGKGLEWIAYIYHNGSAYYNPSLKSPVTISIDGSKNQFSLKLSSVTAADTAVYYCARMSNYDTSGYYDAFDIWGQGTMVTVSS

SEQ ID NO: 6688 - protein, 120 aa, Artificial Sequence; identical to SEQ ID NO: 6685
  Description of Artificial Sequence: Synthetic polypeptide

SEQ ID NO: 6689 - protein, 127 aa, Artificial Sequence
  Description of Artificial Sequence: Synthetic polypeptide
EVQLVESGGGVVQPGRSLRLSCAASGFTFTSYGMHWVRQAPGKGLEWVAVISNDGSNIYYADSVEGRFTISRDNFKNTVYLQMNSLGAEDTAVYYCAKAGNYYDGSGYYSQYYFDNWGRGTLVTVSS

SEQ ID NO: 6690 - protein, 120 aa, Artificial Sequence; identical to SEQ ID NO: 6685
  Description of Artificial Sequence: Synthetic polypeptide

SEQ ID NO: 6691 - protein, 110 aa, Artificial Sequence
  Description of Artificial Sequence: Synthetic polypeptide
DIQLTQSPASLAVSLGQRATISCRTSESVDSYGKSFMHWYQQKPGQPPKLLIYLASNLESGVPARFAQSGSRTDFTLTIDPVEADDAATYYEQQNNEDPVTFGGGTKLEI

SEQ ID NO: 6692 - protein, 234 aa, Artificial Sequence
  Description of Artificial Sequence: Synthetic polypeptide
MKYLLPTAAAGLLLLAAQPAMAELTQSPSSLSASVGDRVTITCRATQSISSYLSWYQQKPGQAPKLLIYGASNLQSGVPSRFSGSGSGTDFTLTINSLQPEDFATYYCQQTLSTPFTFGPGTRVDFKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6693 - protein, 105 aa, Artificial Sequence
  Description of Artificial Sequence: Synthetic polypeptide
MTQSPSSLSASVGDRVNITCRASQSITNYLNWYQQKPGKAPRLLIYAASSLQSGVPSRFSGSGSGTDFTLTISSLQPEDFATYFCQQSYSNRWTFGQGTKLEIKR

SEQ ID NO: 6694 - protein, 113 aa, Artificial Sequence
  Description of Artificial Sequence: Synthetic polypeptide
DIQMTQTPSSVSASVGDRVTIKCQASQSIRRHLSWYQQKPGKRPKLLIYGASNLASGVPSRFSGSGSGTDFTLTISSLQPEDFATYYCQCTYGVGFSSTYGDAFGGGTKVEIK

SEQ ID NO: 6695 - protein, 113 aa, Artificial Sequence
  Description of Artificial Sequence: Synthetic polypeptide
ELQMTQTPSSVSASVGDRVTIKCQASQSIRRHLSWYQQKPGKRPKLLIYGASNLASGVPSRFSGSGSGTDFTLTISSLQPEDFATYYCQCTYGVGFSSTYGDAFGGGTKVEIK

SEQ ID NO: 6696 - protein, 110 aa, Artificial Sequence
  Description of Artificial Sequence: Synthetic polypeptide
DIQLTQTPSFLSASVGDRVTINCQASQNIYSNLAWYQQKPGKPPKLLIYGASTLASGVPSRFSGSGSGTEFTLTISSLQPEDFATYYCQSYVYSSSTADTFGGGTKVEIK

SEQ ID NO: 6697 - protein, 110 aa, Artificial Sequence
  Description of Artificial Sequence: Synthetic polypeptide
ELQLTQTPSFLSASVGDRVTINCQASQNIYSNLAWYQQKPGKPPKLLIYGASTLASGVPSRFSGSGSGTEFTLTISSLQPEDFATYYCQSYVYSSSTADTFGGGTKVEIK

SEQ ID NO: 6698 - protein, 106 aa, Artificial Sequence
  Description of Artificial Sequence: Synthetic polypeptide
DIQMTQTPSSVSASVGDRVTIKCQASQSIGSNLAWYQQKPGKPPKLLIYAASNLASGVPSRFSGSGSGTDFTLTISSLQPEDFATYYCQCNYYLNAFGGGTKVEIK

SEQ ID NO: 6699 - protein, 106 aa, Artificial Sequence
  Description of Artificial Sequence: Synthetic polypeptide
ELQMTQTPSSVSASVGDRVTIKCQASQSIGSNLAWYQQKPGKPPKLLIYAASNLASGVPSRFSGSGSGTDFTLTISSLQPEDFATYYCQCNYYLNAFGGGTKVEIK

SEQ ID NO: 6700 - protein, 110 aa, Artificial Sequence
  Description of Artificial Sequence: Synthetic polypeptide
DIQMTQTPSSLSASVGDRVTIKCQASHNINTYLSWYQQKPGKPPKLLIYRASDLASGVPSRFSGSGSGTDFTFTISSLQPEDIATYYCQQGFNSLNVENVFGGGTKVEIK

SEQ ID NO: 6701 - protein, 110 aa, Artificial Sequence
  Description of Artificial Sequence: Synthetic polypeptide
ELQMTQTPSSLSASVGDRVTIKCQASHNINTYLSWYQQKPGKPPKLLIYRASDLASGVPSRFSGSGSGTDFTFTISSLQPEDIATYYCQQGFNSLNVENVFGGGTKVEIK

SEQ ID NO: 6702 - protein, 133 aa, Artificial Sequence
  Description of Artificial Sequence: Synthetic polypeptide
MESQTQVFLSLLLWVSGTCGNIMMTQSPSSLAVSAGEKVTMSCKSSQSVLYSSNQKNYLAWYQQKPGQSPKLLIYWASTRESGVPDRFTGSGSGTDFTLTISSVQAEDLAVYYCHQYFSSYTFGGGTKLEIKR

SEQ ID NO: 6703 - protein, 146 aa, Artificial Sequence
  Description of Artificial Sequence: Synthetic polypeptide
METDTLLLWVLLLWVPGSTGDIVLTQSPASLAVSLGQRATISCRASQSVSRSSYTYMHWYQQKPGQPPKLLIKYASNLESGVPARFSGSGSGTDFTLNIHPVEEEDTATYYCQHSWEIPYTFGGGTKLEIKRADAAPTVSIFPPSS

SEQ ID NO: 6704 - protein, 141 aa, Artificial Sequence
  Description of Artificial Sequence: Synthetic polypeptide
METDTLLLWVSGTCGDIVMSRSPSSLAVSVGEKVTMTCKSSQSLLYSSNQKNYLAWYQQKQSPKLLIYWASTRESGVPDAFTGSGSGTDFTLTISSVKAEDLAVYYCQQYYRYPYTFGGGTKLEIKRADAAPTVSIFPPSS

SEQ ID NO: 6705 - protein, 152 aa, Artificial Sequence
  Description of Artificial Sequence: Synthetic polypeptide
MKLPVRLLVLMFWIPASSSDVVMTQTPLSLPVSLGGQASISCRSSQSFVHSSGNTYLEWYLQKPGQSPKLLIYRVSNRFSGVPDRFSGSGSGTDFTLKISRVEAEDLGVYYCFQGSHVPYTFGSGTKLEIKRADAAPTVSIFPPSSKLIDDK

SEQ ID NO: 6706 - protein, 109 aa, Artificial Sequence
  Description of Artificial Sequence: Synthetic polypeptide
QSVLTQPPSVSAAPGQMVTISCSGSSSNIGKNYVSWYQQLPGAAPKLLIFDNNKRPSGTPDRFSGSKSGTSATLVITGLQTGDEADYYCGTPDRSLSVIFGGGTKVTVL

SEQ ID NO: 6707 - protein, 111 aa, Artificial Sequence
  Description of Artificial Sequence: Synthetic polypeptide
QSVLTQPPSVSAAPGQKVTISCSGSSSNIGNNFVSWYQQLPGTAPKLLIYDNDRRPSGIPDRFSGSKSDTSATLVITGLQTGDEADYYCETWDGSLNPAVVFGGGTRLTVL

SEQ ID NO: 6708 - protein, 108 aa, Artificial Sequence
  Description of Artificial Sequence: Synthetic polypeptide
SYELTQPPSVSVSPGQTATITCSGDNLGDEFACWYQQKPGQSPVLVIYQDSKRPSGIPERFSGSSSGNTATLTIRGTQAMDEADYYCQAWDSSTAHYVFGTGTKVTVL

SEQ ID NO: 6709 - protein, 112 aa, Artificial Sequence
  Description of Artificial Sequence: Synthetic polypeptide
DIVMTQSPDSLAVSLGERATINCKSSQSVLYSSNNKNYLAWYQQKPGQPPKLLIYWASTRESGVPDRFSGSGSGTDFTLTISSLQAEDVAVYYCQQYYSTPITFGQGTRLEI

SEQ ID NO: 6710 - protein, 110 aa, Artificial Sequence
  Description of Artificial Sequence: Synthetic polypeptide
QSVLTQPPSASGTPGQRVSISCSGSLSNIGTNYVYWYQQLPGTAPKLLIFKNNQRPSGVPDRFSGSKSGTSASLAISGLRSEDEADYYCAAWDDSLNGYVFGTGTKVTVL

SEQ ID NO: 6711 - protein, 106 aa, Artificial Sequence
  Description of Artificial Sequence: Synthetic polypeptide
NIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEI

SEQ ID NO: 6712 - protein, 109 aa, Artificial Sequence
  Description of Artificial Sequence: Synthetic polypeptide
QAVLTQESALTTSPGETVTLTCRSSTGAVTTSNYANWVQEKPDHLFTGLIGGTNNRVPGVPARFSGSLIGDKAALTITGAQTEDEAIYFCVLWHSNHWVFGGGTKLTVL

SEQ ID NO: 6713 - protein, 98 aa, Artificial Sequence
  Description of Artificial Sequence: Synthetic polypeptide
QSVLTQPASVSGSPGQSITISCSGSSSNIGNNYVSWYQQLPGTAPKLLIYDNNKRPSGIPDRFSGSKSGTSATLGITGLQTGDEADYYCGTWDSSLSA

SEQ ID NO: 6714 - protein, 110 aa, Artificial Sequence
  Description of Artificial Sequence: Synthetic polypeptide
EIVLTQSPGTLSLSPGERATLSCRASQSVTSSQLAWYQQKPGQAPRLLISGASNRATGIPDRFSGSGSGTDFTLTISRLEPEDFAVYYCQQYGSSPTFGGGTKVEIKRAA

SEQ ID NO: 6715 - protein, 110 aa, Artificial Sequence
  Description of Artificial Sequence: Synthetic polypeptide
ETTLTQSPGTLSLSPGERATLSCRASQSVSSNYLAWYQKKPGQAPRLLIYGASSRATGIPDRFSGSGSGTDFTLTINRLEPEDFAVYYCQQYGRSPTFGQGTKVEIKRAA

SEQ ID NO: 6716 - protein, 109 aa, Artificial Sequence
  Description of Artificial Sequence: Synthetic polypeptide
ETTLTQSPGILSLSPGDRATLSCRASQSVGSVNLAWYQQRPGQAPRLLIHGASNRATGIPDRFSGVGSGTDFTLTINRLEPDDFAVYYCQQYGTSPITFGQGTRLEIKR

SEQ ID NO: 6717 - protein, 129 aa, Artificial Sequence
  Description of Artificial Sequence: Synthetic polypeptide
MDMRVPAQLLGLLLLWLPGAKCDIQMTQSPSTLSASVGDRVTITCRASQTISTWLAWYQQTPRKAPKLMIYKASILENGVPSRFSGSGSGTEFTLTISSLQPEDFATYYCQQYKSYPWTFGQGTKVEIK

SEQ ID NO: 6718 - protein, 272 aa, Artificial Sequence
  Description of Artificial Sequence: Synthetic polypeptide
MKYLLPTAAAGLLLLAAQPAMAQVKLLESGGGLVQPGGSLRLSCEASGFTFSSYTMNWVRQAPGKGLEWVSWISSSGSDIYYAESVKGRFTISRDNAKNSLYLQMNSLRDEDTALYYCARDGIDSSSSWGGEPYFYTMDFWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTSDYKDDDDKHHHHHH

SEQ ID NO: 6719 - protein, 216 aa, Artificial Sequence
  Description of Artificial Sequence: Synthetic polypeptide
QSVLTQPPSASGTPGQRVSISCSGSLSNIGTNYVYWYQQLPGTAPKLLIFKNNQRPSGVPDRFSGSKSGTSASLAISGLRSEDEADYYCAAWDDSLNGYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 6720 - protein, 108 aa, Artificial Sequence
  Description of Artificial Sequence: Synthetic polypeptide
EIVLTQSPATLSLSPGERATLSCRASQSVGGYLTWYQHKPGQAPRLLIFDASIRATGIPARFSGSGSGTDFTLTITRLEPEDFAVYYCQQRSMWPPVTFGQGTKLEIK

SEQ ID NO: 6721 - protein, 111 aa, Artificial Sequence
  Description of Artificial Sequence: Synthetic polypeptide
NIVLTQSPASLAVSRGQRATISCRASESVDSYGKSFMHWYQQKPGQPPKLLIYLASNLESGVPTRFSGSGSRTDFTLTIDPVEADDAATYYCQQNNEDPRTFGGGTKLEIK

SEQ ID NO: 6722 - protein, 107 aa, Artificial Sequence
  Description of Artificial Sequence: Synthetic polypeptide
VVVLTQSPASLSVTPGDSVSLSCRASQSVSNNLHWYQQKSHGSPRLLIKYASQSISGIPSRFSGSGSGTDFTLNINSVETEDLGMYFCQQSHNWPLTFGAGTKLELK

SEQ ID NO: 6723 - protein, 107 aa, Artificial Sequence
  Description of Artificial Sequence: Synthetic polypeptide
DIVLTQSPATLSVTPGDSVSLSCRASQSISNNLHWYQQKSHESPRLLIKYASQSISGIPSRFSGSGSGTDFTLTINSVETEDFGMYFCQQTNSWPHTFGGGTKLEIK

SEQ ID NO: 6724 - protein, 107 aa, Artificial Sequence
  Description of Artificial Sequence: Synthetic polypeptide
DIVLTQSPATLSVTPGDSVSLSCRASQSISNNLHWYQQKSHESPRLLIKYASQSISGIPSRFSGSGSGTDFTLSVNGVETEDFGMYFCQQSNSWPHTFGGGTKLEIK

SEQ ID NO: 6725 - protein, 75 aa, Artificial Sequence
  Description of Artificial Sequence: Synthetic polypeptide
DVTSSAVTGASSCRSNSVYSDDNNWGGRRYKVSNRDSGVDRSGSGSGTDTKSRVADVGVYYCMGRHWTGGTKVDK

SEQ ID NO: 6726 - protein, 207 aa, Artificial Sequence
  Description of Artificial Sequence: Synthetic polypeptide
  MOD_RES (27)..(27): Any amino acid
LIRLTIGQAVVSTQSTWGLMRIAVISXGPKFKDKMDFQVQIFSFLLISASVILSRGQIVLTQSPAIMSASPGEKVTMTCSASSSISYMHWYQQKPGTSPKRWIYDTSKLASGVPARFSGSGSGTSYSLTISNMESEDAATYYCHQRSRYHTFGGGTRLEIKRADAAPTVSIFPPSSEQLTSGGASVVCFLNNFYPKDINVKWKIDGS

SEQ ID NO: 6727 - protein, 142 aa, Artificial Sequence
  Description of Artificial Sequence: Synthetic polypeptide
MEFGLSWVFLVALLRGVQCQVQLVESGGGVVQPGRSLRLSCAASGFTFSSHVMHWVRQAPGKGLQWLAVTWYDGSNKAYGESVKGRFIISRDNSKNILYLQMNSLRAEDTAVYYCAREGYGRGHYFYGLDVWGRGTTVTVFS

SEQ ID NO: 6728 - protein, 112 aa, Artificial Sequence
  Description of Artificial Sequence: Synthetic polypeptide
DIVMTQSPDSLAVSLGERATINCKSSQSILYSSNNKNYLAWYQQKPGQPPKLLIYWASTRESGVPDRFSGSESGTDFTLTISSLQAEDVAVYYCQQYYSTPTFGPGTKVDIK

SEQ ID NO: 6729 - protein, 107 aa, Artificial Sequence
  Description of Artificial Sequence: Synthetic polypeptide
EIVLTQSPATLSLSPGERATLSCRASQNVSRYLAWYQQKPGQAPRLLIYDASNRATGIPARFSGSGSGTDFTLTISSLEPEDFAVYYCQQRRSWPPTFGGGTKVEIK

SEQ ID NO: 6730 - protein, 112 aa, Artificial Sequence
  Description of Artificial Sequence: Synthetic polypeptide
DIVMTQSPDSLAVSLGERATINCKSSQSVLYSSNNKSFLAWYQQKPGQPPSLLIHWASTRESGVPDRFSGSGSGTDFTLTISSLQAEDVAVYYCQQYYSTPTFGGGTKVEIK

SEQ ID NO: 6731 - protein, 107 aa, Artificial Sequence; identical to SEQ ID NO: 6729
  Description of Artificial Sequence: Synthetic polypeptide

SEQ ID NO: 6732 - protein, 107 aa, Artificial Sequence; identical to SEQ ID NO: 6729
  Description of Artificial Sequence: Synthetic polypeptide

SEQ ID NO: 6733 - protein, 112 aa, Artificial Sequence
  Description of Artificial Sequence: Synthetic polypeptide
DIVMTQSPDSLAVSLGERATINCKSSHSVLYDSNSKNYLAWYQQKPGQPPKLLIYWASTRDSGVPDRFSGSGSGTEFTLTISSLQAEDVALYYCQQYYSTPTFGGGTKVEIK

SEQ ID NO: 6734 - protein, 107 aa, Artificial Sequence; identical to SEQ ID NO: 6729
  Description of Artificial Sequence: Synthetic polypeptide

SEQ ID NO: 6735 - protein, 108 aa, Artificial Sequence
  Description of Artificial Sequence: Synthetic polypeptide
SYELTQPPSVSVSPGQTARITCSGDALPKQYAYWYQQKPGQAPVLVIYKDTERPSGIPERFSGSSSGTTVTLTISGVQAEDEADYYCQSADSSDPYVVFGGGTKLTVL

SEQ ID NO: 6736 - protein, 255 aa, Artificial Sequence
  Description of Artificial Sequence: Synthetic polypeptide
EVQLLESGGGVVQSGRSLRLSCAASGFIFSEYAMHWVRQAPGKGLQWVAVISVDGSDKHYADSVKGRFTISRDNSQNMLFLQMDSLRGDDTAVYYCARDGKSLNGYSGLIDYWGQGSLVTVSSGGGGSGGGGSGGGGSEIVLTQSPATLSLSPGERATLSCRASQSVGGYLAWYQQKPGQAPRLLIYDASNRAAGIPSRFSGSGSGTDFTLTISSLAPEDFAVYFCQQRSSWPPLTFGGGTKVEIKRDYKDDDDK

SEQ ID NO: 6737 - protein, 228 aa, Artificial Sequence
  Description of Artificial Sequence: Synthetic polypeptide
QVQLVQSGAEVKKPGESLKISCKGSGYSFANHWIAWVRQMPGKGLEWMGIFNPDNSDTTYSPSFQGQVTFSADKSISIAYLHWSSLKASDTAIYYCARLALSDGWLHDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHT

SEQ ID NO: 6738 - protein, 127 aa, Artificial Sequence
  Description of Artificial Sequence: Synthetic polypeptide
EVQLVQSGAEVKKPGSSVKVSCKASGGTFSSHAVNWVRQVPGQGLEWMGRVIPILGTVKNAQKFQGRVTITADEATSTAYMELNSLRSEDTAVYYCARGGWCTGDCDARTFVWFEPWGQGTTVTVSS

SEQ ID NO: 6739 - protein, 113 aa, Artificial Sequence
  Description of Artificial Sequence: Synthetic polypeptide
DIQLTQSPDSLAVSLGERATINCKSSQSVLYSSINKNYLAWYQQKPGQPPKLLIYWASTRESGVPDRFSGSGSGTDFTLTISSLQAEDVAVYYCQQYYSTPYTFGQGTKVEIK

SEQ ID NO: 6740 - protein, 212 aa, Artificial Sequence
  Description of Artificial Sequence: Synthetic polypeptide
SYELTQPPSVSVAPGKTARITCGGNNIGSKSVHWYQQKPGQAPVLVVYDDSDRPSGIPERFSGSNSGNTATLTISRVEAGDEADYYCQVWDSSSDYVFGTGTKVTVLGQPKANPTVTLFPPSSEEFQANKATLVCLISDYPGAVTVAWKADGSPVKAGVETTKPSKQSNNKYAASSYLSLTPEQWKSHRSYSCQVTHEGSTVEKTVAPTECS

SEQ ID NO: 6741 - protein, 212 aa, Artificial Sequence
  Description of Artificial Sequence: Synthetic polypeptide
SYELTQPPSVSVAPGKTARITCGGNNIGSKSVHWYQQKPGQAPVLVVYDDSDRPSGIPERFSGSNSGNTATLTISRVEAGDEADYYCQVWDSSSDYVFGTGTKVTVLGQPKANPTVTLFPPSSEEFQANKATLVCLISDFYPGAVTVAWKADGSVKAGVETTKPSKQSNNKYAASSYLSLTPEQWKSHRSYSCQVTHEGSTVEKTVAPTECS

SEQ ID NO: 6742 - protein, 457 aa, Artificial Sequence
  Description of Artificial Sequence: Synthetic polypeptide
MNFGLRLIFLVLTLKGVQCDVKLVESGGGLVKPGGSLKLSCAASGFTFSSYTMSWVRQTPEKRLEWVATISSGGSYTYYPDSVKGRFTISRDNAKNTLYLQMSSLKSEDTAMYYCTRDGNDYDYWGQGTTLTVSSAKTTPPSVYPLAPGSAAQTNSVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 6743 - protein, 233 aa, Artificial Sequence
  Description of Artificial Sequence: Synthetic polypeptide
MAVLALLFCLVTFPSCILSQVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARVGDYGDYFDYWGQGTTLTVSSAKTTPPSVYPLAPGSAAQNSMVTLGCLVKGYFPEPVTVTWNSGSLSSGVHTFPAVLQSDLYTLSSSVTVPSSTWPSETVTCNVAHPASSTKVDKKI

SEQ ID NO: 6744 - protein, 117 aa, Artificial Sequence
  Description of Artificial Sequence: Synthetic polypeptide
EVQLVQSGGGVVQPGKSLRLSCAASGFAFSSYAMHWVRQAPGKGLEWVAVISYDGSNKYYADSVKGRFTISRDNSKNTLYLQMNSLRAEDTAVYYCARDRSYYLDYWGQGTLVTVSS

SEQ ID NO: 6745 - protein, 125 aa, Artificial Sequence
  Description of Artificial Sequence: Synthetic polypeptide
QVQLVESGGGVVQPGRSLRLSCAASGFTFSNYGMHWVRQAPGKGLEWLAVISSDGRIKFYADSVKGRFTMSRDSSKNTLYLQMNSLRAEDTAVYYCAKDRFQFARSWYGDYFDYWGQGTQVTVSS

SEQ ID NO: 6746 - protein, 125 aa, Artificial Sequence
  Description of Artificial Sequence: Synthetic polypeptide
QVTLKESGPVLVKPTETLTLTCTVSVFSLSNARMGVSWIRQPPGKALEWLAHIFSSDQKSYSTSLKSRLTISKDTSKSQVVLTMTNMDPEDTGTYYCARINTAAYDYDSTTFDIWGQGTMVTVSS

SEQ ID NO: 6747 - protein, 123 aa, Artificial Sequence
  Description of Artificial Sequence: Synthetic polypeptide
QVQLVESGGGVVQPGRSLRLSCEASGFTLRTSSLHWVRQAPGKGLEWVAVISNDGATKFYADAVKGRFTISRDNSNNKIYLQLNGLKPEDTAVYYCARETRHYSHGLNWFDPWGQGTLVNVSS

SEQ ID NO: 6748 - protein, 123 aa, Artificial Sequence
  Description of Artificial Sequence: Synthetic polypeptide
QVQLVESGGGVVQPGRSLRLSCAGSGFTFSSFGLHWVRQAPGKGLEWLALISDEGRIKYYANSVKGRFFISRDNSKNTLYLQMNSLRGEDTAVYYCARDVKGHIVVMTSLDYWGQGALVTVSS

SEQ ID NO: 6749 - protein, 126 aa, Artificial Sequence
  Description of Artificial Sequence: Synthetic polypeptide
QVLLVESGGGVVQPGMSLRLSCAASGFTFSSYAMHWVRQAPGKGLEWVAVISYDGSTKFYADSVRGRFPISRDNSKNTVYLQMNSLRPEDTAVYYCATVSVEGYTSGWYLGTLDFWGQGTPVTVSS

SEQ ID NO: 6750 - protein, 127 aa, Artificial Sequence
  Description of Artificial Sequence: Synthetic polypeptide
EVLLVESGGGLVQPGRSLRLSCVVSGFTFDYYAMHWVRQAPGKGLEWVSGISWNSDNTDYADSVKGRFTISRDNAKNSLYLQMNSLKTEDTALYYCAKDISLVFWSVNPPRNGMDVWGQGTTVTVSS

SEQ ID NO: 6751 - protein, 124 aa, Artificial Sequence
  Description of Artificial Sequence: Synthetic polypeptide
LVQLVESGGGVVQPGRSLRLSCAGSGFTFSSYGMHWVRQTPGKGLEWVAVISFDGRNKFYADPVKGRFTISRDNSKNTVFLELDSLTTEDTAFYYCARDDNLDRHWPLRLGGYWGQGTLVTVSS

SEQ ID NO: 6752 - protein, 127 aa, Artificial Sequence
  Description of Artificial Sequence: Synthetic polypeptide
QAQLVESGGALVQPGRSLRLSCAASGFTFRNYAMHWVRQAPATGLQWLAVITSDGRNKFYADSVKGRFTISREDSKNTLYLQMDSLRGEDTAVYYCVTQRDNSRDYFPHYFHDMDVWGQGTTVAVSS

SEQ ID NO: 6753 - protein, 119 aa, Artificial Sequence
  Description of Artificial Sequence: Synthetic polypeptide
DVQLLESGGGLVQPGGSLRLSCAASGFSFSSYAMTWVRQAPGKGLEWVATMSASGDSTNDADSVKGRFTISRDNSKNTLFLQMNSLRPEDTAVYYCASPLRNYGDLLYWGQGTLVTVSS

SEQ ID NO: 6754 - protein, 126 aa, Artificial Sequence
  Description of Artificial Sequence: Synthetic polypeptide
EVQLLESGGGLVQPGGSLRLSCTASGFTFASYAMTWVRQAPGKGLEWVSTISGGGGDTYSADSVKGRFTISRDNSKSTLYLQMNSLRAADTALYYCARLESATQPLGYYFYGMDVWGQGTTVTVSS

SEQ ID NO: 6755 - protein, 117 aa, Artificial Sequence
  Description of Artificial Sequence: Synthetic polypeptide
LESGGGVVQPGRSLRLSCAASGFTFSSYAMHWVRQAPGKGLEWVAVISYDGSTKFYADSVKGRFTISRDNSKNMLYLQMNSLRAEDTAVYYCARHPGYSSGWVYGMDVYWGQGTLVT

SEQ ID NO: 6756 - protein, 117 aa, Artificial Sequence
  Description of Artificial Sequence: Synthetic polypeptide
LESGGGVVQPGRSLRLSCAASGFTFSSYAMHWVRQAPGKGLEWVAVISYDGSNKFYADSVKGRFTISRDNSKNTLYLQMNSLRAEDTAVYYCARHPGYSSGWPPGYFDYWGQGTLVT

SEQ ID NO: 6757 - protein, 107 aa, Artificial Sequence
  Description of Artificial Sequence: Synthetic polypeptide
DIQMTQSPSSVSASVGDRVTITCRASQGISNWLAWYQQKPGKAPKLLIYAASSLQSGVPSRFSGSGSGTDFTLTIRSLQPEDFATYYCQQANNFPLTFGGGTKVEIK

SEQ ID NO: 6758 - protein, 131 aa, Artificial Sequence
  Description of Artificial Sequence: Synthetic polypeptide
LVQLEESGTVLPRPGASVKMSCKASGYTFTSYWMHWVKQRPGQGLEWIGAIYPGNSDTNYNQKFKGRATLTAVTSTSTASMELSSLTNEDSAVYYCTRDGYGSLYYYAMDFWGQGTSVTVSSAKTTAPSVK

SEQ ID NO: 6759 - protein, 107 aa, Artificial Sequence
  Description of Artificial Sequence: Synthetic polypeptide
QVELVESGGGLVKPGGSLRLSCAASGFTFSAYAMSWVRQAPGKGLEWVKGRFTISRDNSKNTLYLQMNSLRAEDTAVYYCAKGGYCTGGVCSSLDYRGQGTLVTVSS

SEQ ID NO: 6760 - protein, 464 aa, Artificial Sequence
  Description of Artificial Sequence: Synthetic polypeptide
MEFGLSWVFLVAIIKGVQCQVQLQESGGGLVKPGGSLKLSCAASGFTFSSYTMSWVRQTPDKRLEWVATISSGGSYTYYPDSVKGRFTISRDNAKNTLYLQMSSLKSEDTAMYYCARDGNDYDYWGQGTMVTVSSASTKGPSVFPLAPSSKSTSGTAALGCLVKDYFPEPVTVSWNSGALTSGVHTFPAALQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6761 - protein, 452 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTASYAQKFQGRVTITADKSTSTAYMELSSLRSEDTAVYYCARVGYCSSTSCNRGAFDIWGQGTMVTVSSASTKGPSVFPLAPSSKSTSGGTAALGCLVKYPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6762 - protein, 457 aa, Artificial Sequence
  Description of Artificial Sequence: Synthetic polypeptide
QVQLQQSGAEVKKPGSSVKVSCKASGGTFSSYTISWVRQAPGQGLEWMGRIIPIFGTANYAQKFQGRVTITADKSTSTAYMELSSLRSEDTAVYYCARDLGPGGDSSGYYYGPGAFDIWGQGTMVTVSSASTKGPSVFPLAPSSKSTSGGTAALCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6763 - protein, 455 aa, Artificial Sequence
  Description of Artificial Sequence: Synthetic polypeptide
QVQLQQSGAEVKKRGSSVKVSCKASGGTFSSYTISWVRQAPGQGLEWMGRIIPILGIANYAQKFQGRVTITADKSTSTAYMELSSLRSEDTAVYYCARDLYDSSGYYRNTDAFDIWGQGTMVTVSSASTKGPSVFPLAPSSKSTSGGTAALGCLVDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6764 - protein, 458 aa, Artificial Sequence
  Description of Artificial Sequence: Synthetic polypeptide
MAVLALLFCLVTFPSCILSQVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARVGDYGDYFDYWGQGTTLTVSSAKTTPPSVYPLAPGSAAQSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 6765 - protein, 251 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTASYAQKFQGRVTITADKSTSTAYMELSSLRSEDTAVYYCARVGYCSSTSCNRGAFDIWGQGTMVTVSSASTKGPSVFPLAPSSKSTSGGTAALGCLVKYFPEPVTVSWNSGALTSGVHTFPAVLQSSGLYSLSSVVTVPSSSLGTQTYICNVNHKPSNTKVDKKVEPKSCDKTSGQAGHHHHHHGDYKDDDDKG

SEQ ID NO: 6766 - protein, 117 aa, Artificial Sequence
  Description of Artificial Sequence: Synthetic polypeptide
QMQLVQSGTEVKKPGESLKISCKGSGYGFITYWIGWVRQMPGKGLEWMGIIYPGDSETRYSPSFQGQVTISADKSINTAYLQWSSLKASDTAIYYCAGGSGISTPMDVWGQGTTVTV

SEQ ID NO: 6767 - protein, 468 aa, Artificial Sequence
  Description of Artificial Sequence: Synthetic polypeptide
MGWSCIILFLVATATGVHSEVQLLETGGGLVKPGGSLRLSCAASGFSLSDYYMNWIRQAPGKGLEWVAYISSSSGYTNYGDSVKGRFTISRDHAKNSLYLQMNSLRVEDTAVYYCVRDRDDFWSGYYKHWGLGTLVTVSSASTKGPSVFPLAPSSSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYQKSLSLSPGK

SEQ ID NO: 6768 - protein, 231 aa, Artificial Sequence
  Description of Artificial Sequence: Synthetic polypeptide
MGWSCIILFLVATATGVHCAIRMTQSPSFLSASVGDRVTITCRASQDINSFLAWYQQRPGKAPKLLIYGASNLETGVPSRFSGGGSGTDFTLTISSLQPEDIATYYCQQYDKLPTFGQGTRLEIKRTVAAPSVFIFPPSDEQLKSGTASVVCLLNNFYPEAKVQWKVDNALQSGNSQESVTEQDSKDSTYSLSSTLTLSKADYEKHKVYACEVTHQGLSSPVTKSFNRGEC

SEQ ID NO: 6769 - protein, 459 aa, Artificial Sequence
  Description of Artificial Sequence: Synthetic polypeptide
MGWSCIILFLVATATGVHSEVQLVESGGGLVQPGRSLRLSCAASGFTFSNYAMYWVRQAPGKGLEWVALISYDISTDYYADSVKGRFTISRDNSKNTIYLQMNNLRTEDTALYYCAGNDYWGQGTLVTVSSASTKGPSVFPLAPSSKSTSGGTAAGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGEPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESGQPENNYKTTPPVLDSDGSFFLYSKLTVDGSRWQQGNVFSCSVMHEALHNHYTQKSLSLSPGK

SEQ ID NO: 6770 - protein, 234 aa, Artificial Sequence
  Description of Artificial Sequence: Synthetic polypeptide
MGWSCIILFLVATATGSWAQSVLTQSPSASGTPGQRVTISCSGSSSNIGNNYVYWYQQLPGTAPKLLIYWNDQRPSGVPDRFSGSKSGTSASLAISGLRSEDEADYYCAAWDDSLSGAVFGGGTQLTVLGQPKAAPSVTLFPPSSEELQANKATLCLISDFYPGAVTVAWKADSSPVKAGVETTTPSKQSNNKYAASSYLSLTPEQWKSHRSYSCQVTHEGSTVEKTVAPTECS

SEQ ID NO: 6771 - protein, 108 aa, Artificial Sequence
  Description of Artificial Sequence: Synthetic polypeptide
DIRVTQSPPSLSASIGDRVTITCRASQNIRNSLNWYQQKPGKAPKLLIYAAYSLQSGVPSRFSGSGSGTDFTLTISSLQPEDFATYYCQQSYSTPITFGQGTKLEIKR

SEQ ID NO: 6772 - protein, 219 aa, Artificial Sequence
  Description of Artificial Sequence: Synthetic polypeptide
EIVMTQSPLSLPVTLGQPASISCKSSQSLVDTNGNTYLIWFHQRPGQSPRRLIYQVSKRDSGVPDRFSGSGSGTDFTLKISRVEAEDVGVYFCMQGTYRPPTLGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6773 - protein, 233 aa, Artificial Sequence
  Description of Artificial Sequence: Synthetic polypeptide
MSVPTQVLGLLLLWLTGARCDIQMTQSPASLSASVGETVTITCRASENIYSYLAWYQQKQGKSPQLLVYNAKTLAEGVPSRFSGSGSGTQFSLKINSLQPEDFGSYYCQHHYGTPWTFGGGTKLEIKRADAAPTVSIFPPSSEQLTSGGASVVCFLNFYPKDINVKWKIDGSERQNGVLNSWTDQDSKDSTYSMSSTLTLTKDEYERHNSYTCEATHKTSTSPIVKSFNRNEC

SEQ ID NO: 6774 - protein, 247 aa, Artificial Sequence
  Description of Artificial Sequence: Synthetic polypeptide
MAEVQLVQSGGGVVQPGKSLRLSCAASGFAFSSYAMHWVRQAPGKGLEWVAVISYDGSNKYYADSVKGRFTISRDNSKNTLYLQMNSLRAEDTAVYYCARDRSYYLDYWGQGTLVTVSSGGGGSGGGGSGGGGSETTLTQSPATLSLSPGERATLSCRASQSVRSNLAWYQQKPGQAPRPLIYDASTRATGIPDRFSGSGSGTDFTLTISRLEPEDFAVYYCQQRSNWPPTFGQGTKVEVKSGLVPR

SEQ ID NO: 6775 - protein, 109 aa, Artificial Sequence
  Description of Artificial Sequence: Synthetic polypeptide
QSVLTQPPSVSGSPGQSITISCTGTSSDVGAYNFVSWYQQHPGKAPKLMIYDVSNRPSGVSNRFSGSKSGNAASLTISGLQAEDEADYYCSSYTTRSTRVFGGGTKLTV

SEQ ID NO: 6776 - protein, 244 aa, Artificial Sequence
  Description of Artificial Sequence: Synthetic polypeptide
QVQLQQSGAEVKKPGSSVKVSCKASGGTFSSYTISWVRQAPGQGLEWMGGITPILGIANYAQKFQGRVTITTDESTSTAYMELSSLRSEDTAVYYCARDTVMGGMDVWGQGTTVTVSSASTKGPSVFPLAPSSKSTSGGTSALGCLVKDYFPEPTVSWNSGALTSGVHTFPAVLQSSGLYSLSSVVTVPSSSLGTQTYICNVNHKPSNTKVDKKVEPKSCDKTSPLFVHHHHHHGDYKDDDDKG

SEQ ID NO: 6777 - protein, 245 aa, Artificial Sequence
  Description of Artificial Sequence: Synthetic polypeptide
QVQLQQSGAEVKKPGSSVKVSCKASGGTFSSYTISWVRQAPGQGLEWMGGITPILGIANYAQKFQGRVTITTDESTSTAYMELSSLRSEDTAVYYCARDTVMGGMDVWGQGTTVTVSSASTKGPSVFPLAPSSKSTSGGTSALGCLVKDYFPEPVTVSWNSGALTSGVHTFPAVLQSSGLYSLSSVVTVPSSSLGTQTYICNVNHKPSNTKVDKKVEPKSCDKTSPLFVHHHHHHGDYKDDDDKG

SEQ ID NO: 6778 - protein, 234 aa, Artificial Sequence
  Description of Artificial Sequence: Synthetic polypeptide
MIASAQFLGLLLLCFQGTRCDIQMTQTTSSLSASLGDRVTISCRASQDISNYLNWYQQKPDGTVKLLIYYTSRLHSGVPSRFSGSGSGTDYSLTISNLEQEDIATYFCQQGNTLPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNSNEC

SEQ ID NO: 6779 - protein, 106 aa, Artificial Sequence
  Description of Artificial Sequence: Synthetic polypeptide
TTLTQSPATLSLSPGERATLSCRASQSVRSNLAWYQQKPGQAPRPLIYDASTRATGIPDRFSGSGSGTDFTLTISRLEPEDFAVYYCQQRSNWPPTFGQGTKVEVK

SEQ ID NO: 6780 - protein, 112 aa, Artificial Sequence
  Description of Artificial Sequence: Synthetic polypeptide
AVAMTQSPLSLPVTLGQPASISCRSNQSLVYSDGNIYLNWFQQRPGQSPMRLIYRVSNRDSGVPDRFSGSGSGTDFTLKISRVEAEDVGIYYCMQGTHWPPTFGGGTKVEIK

SEQ ID NO: 6781 - protein, 107 aa, Artificial Sequence
  Description of Artificial Sequence: Synthetic polypeptide
DIQMTQSPSSLSASVGDRVTITCRASQTISNYLNWYQQKPGKAPKLLLYAASSLQSGVPSRFSGSGSGTDFTLTISSLQLEDFATYYCQQSYSTPPTFGGGTKVEIK

SEQ ID NO: 6782 - protein, 107 aa, Artificial Sequence
  Description of Artificial Sequence: Synthetic polypeptide
ERVMTQSPVTLSVSPGERATLSCRASQSVSSDLAWYQQKPGQAPRLLIYGASTRATGIPARFSGSGSGTEFTLTISSLQSEDFAVYYCQQYNNWPTTFGQGTRLDIK

SEQ ID NO: 6783 - protein, 112 aa, Artificial Sequence
  Description of Artificial Sequence: Synthetic polypeptide
DVVMTQSPLSLPVTLGQPASISCRSSQSLVSSDGDTSLSWFQQRPGQSPRRLIYEVSNRDSGVPDRFSGSGSGTDFTLKISRVEAEDVGVYYCMQGTHWPPTFGQGTKVEIK

SEQ ID NO: 6784 - protein, 107 aa, Artificial Sequence
  Description of Artificial Sequence: Synthetic polypeptide
ERVMTQFPATLSVSPGERATLSCRASQSVSSNLAWYQQKPGQAPRLLIYGASTRAIGVPARFSGSGSGTEFTLTISSLQSEDFAVYYCQQYNNWPGTFGQGTKLEIK

SEQ ID NO: 6785 - protein, 107 aa, Artificial Sequence
  Description of Artificial Sequence: Synthetic polypeptide
DIQMTQSPSSLSASVGDRVTITCRASQSIRSYLNWYQQKPGKAPNLLIYTASSLQSGVPSRFSGSGSGTDFTLTISSLQPEDFATYYCQQSYSSPLTFGGGTKVEIK

SEQ ID NO: 6786 - protein, 112 aa, Artificial Sequence
  Description of Artificial Sequence: Synthetic polypeptide
EIVMTQSPLSLPVTLGQPASISCRSSQDLLYNDGGTDLNWFQQRPGQSPRRLIYRVSNRDSGVPDRFSGSGSGSDFTLKISRVEAEDVGIYYCMQGAHWPPTFGPGTKVEIK

SEQ ID NO: 6787 - protein, 112 aa, Artificial Sequence
  Description of Artificial Sequence: Synthetic polypeptide
DVVLTQSPLSLPVTLGQPASISCRSSQSLVYSDGDTYLNWFQQRPGQSPRRLIYQVSNRDSGVPDRFSGSGSGTDFTLKISRVEAEDVGVYYCMQGSHWPPTFGQGTKVEIK

SEQ ID NO: 6788 - protein, 107 aa, Artificial Sequence
  Description of Artificial Sequence: Synthetic polypeptide
DIQMTQSPSTLSASVGDRVTITCRASQNIHRFLAWYQQKPGKAPKLLIYTASSLESGVPSRFSGSGFGTEFTLTISSLQPDDFATYYCQQYNSYSWTFGQGTKVEIK

SEQ ID NO: 6789 - protein, 109 aa, Artificial Sequence
  Description of Artificial Sequence: Synthetic polypeptide
SYELTQPPSVSVSPGQTARITCSGDALPKQYAFWYQQRPGQAPVLVISKDSERPSGIPERFSGSSSGTTVTLTISGVQAEDEADYYCHSADISATSWVFGGGTKLTVVS

SEQ ID NO: 6790 - protein, 104 aa, Artificial Sequence
  Description of Artificial Sequence: Synthetic polypeptide
ELTQSPATLSVSPGERATLSCRASQSVSSDLPWYQQKPGQAPRLLIYGASTRATGIPARFSGGSGTEFTLTISSLQSEDFAVYYCQQYNNWPPVFGGGTKVEIK

SEQ ID NO: 6791 - protein, 104 aa, Artificial Sequence
  Description of Artificial Sequence: Synthetic polypeptide
ELTQSPATLSVSPGERATLSCRASQSVSSNLAWYQQKPGQAPRLLIYGASTRATGIPARFSGGSGTEFTLTISSLQSENFAVYYCQQYNNWPQTFGQGTKVEIK

SEQ ID NO: 6792 - protein, 125 aa, Artificial Sequence
  Description of Artificial Sequence: Synthetic polypeptide
QVQLVESGGGVVQPGTSLRLSCAASGFTFSSYGIHWVRQAPGKGLEWVAVIWYDGSNKFYADSVKGRFTISRDNSKNTLYLQMNSLRAEDTAVYYCARDPLGYCSSTSCSYFDYWGQGTLVTVSS

SEQ ID NO: 6793 - protein, 127 aa, Artificial Sequence
  Description of Artificial Sequence: Synthetic polypeptide
ELVMTQSPSSLSASLGDRVTISCRASQDISNYLNWYQQKPDGTVKLLIYYTSRLHAGVPSRFSGSGSGTDYSLTISNLEQEDIATYFCQQGYTLPYTFGGGTKLEIKRADAAPTVSKGEFQHTGGRY

SEQ ID NO: 6794 - protein, 216 aa, Artificial Sequence
  Description of Artificial Sequence: Synthetic polypeptide
RCDIQLTQSPSSLSASIGDRVTITCQASQDISNYLNWYQQRPGQAPKLLIYYTSRLHSGVPSRFSGRGSGTSFTIAINSFQAEDIGTYFCQQGNTLPRTFGGGTRVEIKRTVAAPSVFIFPPSDEQLKSGTASVVCLLNNFYPREAKVQWKVDNALQSNSQESVTEQDSKDSTYSLSSTLTLSKADYEKHKVYACEVTHQGLSSPVTKSFNRGECS

SEQ ID NO: 6795 - protein, 212 aa, Artificial Sequence
  Description of Artificial Sequence: Synthetic polypeptide
DIQLTQSPSSLSASVGDRVTITCRASQGIRNDLGWYQQKPGKAPKLLIYAASSLQSGVPSRFSGSGSGTDFTLTISSLQPEDFATYYCQQLNSYPLTFGGGTKVEIKRTVAAPSVFIFPPSDEQLKSGTASVVCLLNNFYPREAKVQWKVDNALQSGSESVTEQDSKDSTYSLSSTLTLSKADYEKHKVYACEVTHQGLSSPVTKSFNRGEC

SEQ ID NO: 6796 - protein, 217 aa, Artificial Sequence
  Description of Artificial Sequence: Synthetic polypeptide
EIVLTQSPLSLPVTPGEPASISCRSSQSLLHSNGYNYLDWYLQKPGKSPQLLIYLGSNRASGVPDRFSGSGSGTDFTLKISRVEAEDVGVYYCMQALQTPLTFGGGTKVEIKRTVAAPSVFIFPPSDEQLKSGTASVVCLLNNFYPREAKVQWKVDNLSGNSQESVTEQDSKDSTYSLSSTLTLSKADYEKHKVYACEVTHQGLSSPVTKSFNRGEC

SEQ ID NO: 6797 - protein, 213 aa, Artificial Sequence
  Description of Artificial Sequence: Synthetic polypeptide
EIVMTQSPVTLSLSPGERATLSCRASQSVSSYLAWYQQKPGQAPRLLIYDASNRATGIPARFSGSGSGTDFTLTISSLEPEDFAVYYCQQYGSSPWTFGQGTKVEIKRTVAAPSVFIFPPSDEQLKSGTASVVCLLNNFYPREAKVQWKVDNALQSNSQESVTEQDSKDSTYSLSSTLTLSKADYEKHKVYACEVTHQGLSSPVTKSFNRGEC

SEQ ID NO: 6798 - protein, 233 aa, Artificial Sequence; identical to SEQ ID NO: 6773
  Description of Artificial Sequence: Synthetic polypeptide

SEQ ID NO: 6799 - protein, 212 aa, Artificial Sequence; identical to SEQ ID NO: 6795
  Description of Artificial Sequence: Synthetic polypeptide

SEQ ID NO: 6800 - protein, 213 aa, Artificial Sequence
  Description of Artificial Sequence: Synthetic polypeptide
DVKLVESGGGLVKPGGSLKLSCAASGFTFSSYTMSWVRQTPEKRLEWVATISSGGSYTYYPDSVKGRFTISRDNAKNTLYLQMSSLKSEDTAMYYCTRDGNDYDYWGQGTTLTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKI

SEQ ID NO: 6801 - protein, 214 aa, Artificial Sequence
  Description of Artificial Sequence: Synthetic polypeptide
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNSNEC

SEQ ID NO: 6802 - protein, 146 aa, Artificial Sequence
  Description of Artificial Sequence: Synthetic polypeptide
MVDIPMGCSWVILFLLSGTAGVHSEVQLQQSGPELVKPGASMKISCKASGYSFTGYTMNWVKESHGKNLDWIGLINPYNGGTRYDQKFKGKATLTVDKSSTTAYMELLSLTSEDSAVYYCARSHHYASGDEYFDYWGQGTTLTVSS

SEQ ID NO: 6803 - protein, 141 aa, Artificial Sequence
  Description of Artificial Sequence: Synthetic polypeptide
MECSWVMLFLLSGTAGVHSEVHLQQSGPELVKPGASMKISCRTSGYSFTGYTMNWVKQTHGKILEWIGLINPYNGGVTYNQKFKGKATLTVDKSSSTTYLELLSLTSEDSAVYYCARSHNYGTGDEYFDYWGQGTTLTVYS

SEQ ID NO: 6804 - protein, 142 aa, Artificial Sequence
  Description of Artificial Sequence: Synthetic polypeptide
MLEWSWVILFLLSGTAGVHSEVQLQQSGPELVKPGASMKISCKASGYSFTGYTLTWVKQSHGKNLDWIGLINPYNGGTRYNQKFKGKATLTVDKSSSTAYMELLSLTSEDSAVYYCARLGYYATGDEYFDYWGQGTTLTVSS

SEQ ID NO: 6805 - protein, 119 aa, Artificial Sequence
  Description of Artificial Sequence: Synthetic polypeptide
EVQLQQSGTVLARPGASVKMSCKASAYTFTRYWMHWVKQRPGQGLEWIGAIYPGNSDTTYNQKFKGKAKLTAVTSTSTAYMELSSLTNEDSAVYYCTKKGVRYYALDYWGQGTSVTVSS

SEQ ID NO: 6806 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYSGGTRYNQKFKGKATLTVDKSSSTAYMELLSLTSEDSAVYYCARLGYYATGDEYFDYWGQGTTLTVSS

SEQ ID NO: 6807 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYQGGTRYNQKFKGKATLTVDKSSSTAYMELLSLTSEDSAVYYCARLGYYATGDEYFDYWGQGTTLTVSS

SEQ ID NO: 6808 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYDGGTRYNQKFKGKATLTVDKSSSTAYMELLSLTSEDSAVYYCARLGYYATGDEYFDYWGQGTTLTVSS

SEQ ID NO: 6809 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYHGGTRYNQKFKGKATLTVDKSSSTAYMELLSLTSEDSAVYYCARLGYYATGDEYFDYWGQGTTLTVSS

SEQ ID NO: 6810 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYTGGTRYNQKFKGKATLTVDKSSSTAYMELLSLTSEDSAVYYCARLGYYATGDEYFDYWGQGTTLTVSS

SEQ ID NO: 6811 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYAGGTRYNQKFKGKATLTVDKSSSTAYMELLSLTSEDSAVYYCARLGYYATGDEYFDYWGQGTTLTVSS

SEQ ID NO: 6812 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYLGGTRYNQKFKGKATLTVDKSSSTAYMELLSLTSEDSAVYYCARLGYYATGDEYFDYWGQGTTLTVSS

SEQ ID NO: 6813 - protein, 141 aa, Artificial Sequence
  Description of Artificial Sequence: Synthetic polypeptide
  MOD_RES (74)..(74): Any amino acid
MDFGLSLVFLVLILKGVQCEVQLQQSGPELVKPGASMKISCKASGYSFTGYTLTWVKQSHGKNLDWIGLINPYXGGTRYNQKFKGKATLTVDKSSSTAYMELLSLTSEDSAVYYCARLGYYATGDEYFDYWGQGTTLTVSS

SEQ ID NO: 6814 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYNAGTRYNQKFKGKATLTVDKSSSTAYMELLSLTSEDSAVYYCARLGYYATGDEYFDYWGQGTTLTVSS

SEQ ID NO: 6815 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYNVGTRYNQKFKGKATLTVDKSSSTAYMELLSLTSEDSAVYYCARLGYYATGDEYFDYWGQGTTLTVSS

SEQ ID NO: 6816 - protein, 141 aa, Artificial Sequence
  Description of Artificial Sequence: Synthetic polypeptide
MDFGLSLVFLVLILKGVQCEVQLQQSGPELVKPGASMKISCKASGYSFTGYTLTWVKQSHGKNLDWIGLINPYNPGTRYNQKFKGKATLTVDKSSSTAYMELLSLTSEDSAVYYCARLGYYATGDEYFDYWGQGTTLTVSS

SEQ ID NO: 6817 - protein, 141 aa, Artificial Sequence
  Description of Artificial Sequence: Synthetic polypeptide
  MOD_RES (75)..(75): Any amino acid
MDFGLSLVFLVLILKGVQCEVQLQQSGPELVKPGASMKISCKASGYSFTGYTLTWVKQSHGKNLDWIGLINPYNXGTRYNQKFKGKATLTVDKSSSTAYMELLSLTSEDSAVYYCARLGYYATGDEYFDYWGQGTTLTVSS

SEQ ID NO: 6818 - protein, 125 aa, Artificial Sequence
  Description of Artificial Sequence: Synthetic polypeptide
QVQLVESGGGVVQPGRSLRLSCAASGFSFDRNYWIAWVRQAPGKGLEWVAVISAGGSGNTYYATWAKGRFTISRDNSKNTLYLQMNSLRAEDTAVYYCARFYSGGGYYAGYFTLWGQGTLVTVSS

SEQ ID NO: 6819 - protein, 454 aa, Artificial Sequence
  Description of Artificial Sequence: Synthetic polypeptide
QVQLVESGGGVVQPGRSLRLSCAASGFSFDRNYWIAWVRQAPGKGLEWVAAISAGGSGNTYYATWAKGRFTISRDNSKNTLYLQMNSLRAEDTAVYYCARFYSGGGYYAGYFTLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 6820 - protein, 125 aa, Artificial Sequence
  Description of Artificial Sequence: Synthetic polypeptide
QVQLVESGGGVVQPGRSLRLSCAASGFSFDRNYWMAWVRQAPGKGLEWVAVIAAGGSGNTYYATWAKGRFTISRDNSKNTLYLQMNSLRAEDTAVYYCARFYSGGGYYAGYFTLWGQGTLVTVSS

SEQ ID NO: 6821 - protein, 125 aa, Artificial Sequence
  Description of Artificial Sequence: Synthetic polypeptide
QVQLVQSGGGVVQPGRSLRLSCAASGFSFDRNYWMAWVRQAPGKGLEWVAVIAAGGSGNTYYATWAKGRFTISKDNSKNTLYLQMNSLRAEDTAVYYCARFYSGGGYYAGYFTLWGQGTLVTVSS

SEQ ID NO: 6822 - protein, 125 aa, Artificial Sequence
  Description of Artificial Sequence: Synthetic polypeptide
QVQLVQSGGGVVQPGESLRLSCAASGFSFDRNYWMSWVRQAPGKGLEWAAVIAAGGSGNTYYATWAKGRFTISKDNSKNTVYLQMNSLRAEDTAVYFCARFYSGGGYYAGYFTLWGQGTLVTVSS

SEQ ID NO: 6823 - protein, 125 aa, Artificial Sequence
  Description of Artificial Sequence: Synthetic polypeptide
QVQLVQSGGGVVQPGESLRLSCAASGFSFDRNYWMCWVRQAPGKGLEWAACIAAGGSGNTYYATWAKGRFTISKDNSKNTVYLQMNSLRAEDTAVYFCARFYSGGGYYAGYFTLWGQGTLVTVSS

SEQ ID NO: 6824 - protein, 125 aa, Artificial Sequence
  Description of Artificial Sequence: Synthetic polypeptide
  MOD_RES (2)..(2): Any amino acid
QXQLVQSGGGVVQPGESLRLSCAASGFSFDRNYWMAWVRQAPGKGLEWAAVIAAGGSGNTYYATWAKGRFTISKDNSKNTVYLQMNSLRAEDTAVYFCARFYSGGGYYAGYFTLWGQGTLVTVSS

SEQ ID NO: 6825 - protein, 125 aa, Artificial Sequence
  Description of Artificial Sequence: Synthetic polypeptide
  MOD_RES (78)..(78): Any amino acid
QVQLVQSGGGVVQPGESLRLSCAASGFSFDRNYWMAWVRQAPGKGLEWAAVIAAGGSGNTYYATWAKGRFTISKTSSXTTVYLQMNSLRAEDTAVYFCARFYSGGGYYAGYFTLWGQGTLVTVSS

SEQ ID NO: 6826 - protein, 125 aa, Artificial Sequence
  Description of Artificial Sequence: Synthetic polypeptide
  MOD_RES (2)..(2): Any amino acid
  MOD_RES (78)..(78): Any amino acid
QXQLVQSGGGVVQPGESLRLSCAASGFSFDRNYWMAWVRQAPGKGLEWAAVIAAGGSGNTYYATWAKGRFTISKTSSXTTVYLQMNSLRAEDTAVYFCARFYSGGGYYAGYFTLWGQGTLVTVSS

SEQ ID NO: 6827 - protein, 125 aa, Artificial Sequence
  Description of Artificial Sequence: Synthetic polypeptide
  MOD_RES (2)..(2): Any amino acid
  MOD_RES (78)..(78): Any amino acid
QXQLVQSGGGVVQPGESLRLSCAASGFSFDRNYWMSWVRQAPGKGLEWAAVIAAGGSGNTYYATWAKGRFTISKTSSXTTVYLQMNSLRAEDTAVYFCARFYSGGGYYAGYFTLWGQGTLVTVSS

SEQ ID NO: 6828 - protein, 125 aa, Artificial Sequence
  Description of Artificial Sequence: Synthetic polypeptide
  MOD_RES (2)..(2): Any amino acid
  MOD_RES (78)..(78): Any amino acid
QXQLVQSGGGVVQPGESLRLSCAASGFSFDRNYWMCWVRQAPGKGLEWAACIAAGGSGNTYYATWAKGRFTISKTSSXTTVYLQMNSLRAEDTAVYFCARFYSGGGYYAGYFTLWGQGTLVTVSS

SEQ ID NO: 6829 - protein, 109 aa, Artificial Sequence
  Description of Artificial Sequence: Synthetic polypeptide
AIQLTQSPSSLSASVGDRVTITCQASQSIGNNLAWYQQKPGKAPKLLIYLASYLASGVPSRFSGSGSGTDFTLTISSLQPEDFATYYCQSAYYSPNDNAFGQGTKVEIK

SEQ ID NO: 6830 - protein, 125 aa, Artificial Sequence
  Description of Artificial Sequence: Synthetic polypeptide
  MOD_RES (2)..(2): Any amino acid
  MOD_RES (79)..(79): Any amino acid
QXSLEESGGDLVKPGASLTLTCTASGFSFDRNYWMCWVRQAPGMGLEWAACIAAGGNGNTYYATWAKGRFTISKTSSTXTVTLQMASLTAADTATYFCARFYNGGGYYAGYFTLWGPGTLVTVSS

SEQ ID NO: 6831 - protein, 125 aa, Artificial Sequence
  Description of Artificial Sequence: Synthetic polypeptide
  MOD_RES (32)..(32): Any amino acid
  MOD_RES (56)..(56): Any amino acid
  MOD_RES (101)..(114): Any amino acid
QVQLVESGGGVVQPGRSLRLSCAASGFTFSSXYAMHWVRQAPGKGLEWVAVISYDXGSNKYYADSVKGRFTISRDNSKNTLYLQMNSLRAEDTAVYYCARXXXXXXXXXXXXXXWGQGTLVTVSS

SEQ ID NO: 6832 - protein, 125 aa, Artificial Sequence; identical to SEQ ID NO: 6818
  Description of Artificial Sequence: Synthetic polypeptide

SEQ ID NO: 6833 - protein, 125 aa, Artificial Sequence
  Description of Artificial Sequence: Synthetic polypeptide
QVQLVESGGGVVQPGRSLRLSCAASGFSFDRNYWIAWVRQAPGKGLEWVAGISAGGSGNTYYATWAKGRFTISRDNSKNTLYLQMNSLRAEDTAVYYCARFYSGGGYYAGYFTLWGQGTLVTVSS

SEQ ID NO: 6834 - protein, 125 aa, Artificial Sequence
  Description of Artificial Sequence: Synthetic polypeptide
QVQLVQSGGGVVQPGRSLRLSCAVSGFSFDRNYWIAWVRQAPGKGLEWVAVISAGGSGNTYYATWAKGRFTISKDNSKNTLYLQMNSLRAEDTAVYYCARFYSGGGYYAGYFTLWGQGTLVTVSS

SEQ ID NO: 6835 - protein, 125 aa, Artificial Sequence
  Description of Artificial Sequence: Synthetic polypeptide
QVQLVQSGGGVVQPGESLRLSCAVSGFSFDRNYWIAWIRQAPGKGLEWAAVISAGGSGNTYYATWAKGRFTISKDNSKNTVYLQMNSLRAEDTAVYFCARFYSGGGYYAGYFTLWGQGTLVTVSS

SEQ ID NO: 6836 - protein, 125 aa, Artificial Sequence
  Description of Artificial Sequence: Synthetic polypeptide
QVQLVQSGGGVVQPGESLRLSCAVSGFSFDRNYWISWIRQAPGKGLEWAAVISAGGSGNTYYATWAKGRFTISKDNSKNTVYLQMNSLRAEDTAVYFCARFYSGGGYYAGYFTLWGQGTLVTVSS

SEQ ID NO: 6837 - protein, 125 aa, Artificial Sequence
  Description of Artificial Sequence: Synthetic polypeptide
QVQLVQSGGGVVQPGESLRLSCAVSGFSFDRNYWICWIRQAPGKGLEWAACISAGGSGNTYYATWAKGRFTISKDNSKNTVYLQMNSLRAEDTAVYFCARFYSGGGYYAGYFTLWGQGTLVTVSS

SEQ ID NO: 6838 - protein, 125 aa, Artificial Sequence
  Description of Artificial Sequence: Synthetic polypeptide
  MOD_RES (2)..(2): Any amino acid
QXQLVQSGGGVVQPGESLRLSCAVSGFSFDRNYWIAWIRQAPGKGLEWAAVISAGGSGNTYYATWAKGRFTISKDNSKNTVYLQMNSLRAEDTAVYFCARFYSGGGYYAGYFTLWGQGTLVTVSS

SEQ ID NO: 6839 - protein, 125 aa, Artificial Sequence
  Description of Artificial Sequence: Synthetic polypeptide
  MOD_RES (78)..(78): Any amino acid
QVQLVQSGGGVVQPGESLRLSCAVSGFSFDRNYWIAWIRQAPGKGLEWAAVISAGGSGNTYYATWAKGRFTISKTSSXTTVYLQMNSLRAEDTAVYFCARFYSGGGYYAGYFTLWGQGTLVTVSS

SEQ ID NO: 6840 - protein, 125 aa, Artificial Sequence
  Description of Artificial Sequence: Synthetic polypeptide
  MOD_RES (2)..(2): Any amino acid
  MOD_RES (78)..(78): Any amino acid
QXQLVQSGGGVVQPGESLRLSCAVSGFSFDRNYWIAWIRQAPGKGLEWAAVISAGGSGNTYYATWAKGRFTISKTSSXTTVYLQMNSLRAEDTAVYFCARFYSGGGYYAGYFTLWGQGTLVTVSS

SEQ ID NO: 6841 - protein, 125 aa, Artificial Sequence
  Description of Artificial Sequence: Synthetic polypeptide
  MOD_RES (2)..(2): Any amino acid
  MOD_RES (78)..(78): Any amino acid
QXQLVQSGGGVVQPGESLRLSCAVSGFSFDRNYWISWIRQAPGKGLEWAAVISAGGSGNTYYATWAKGRFTISKTSSXTTVYLQMNSLRAEDTAVYFCARFYSGGGYYAGYFTLWGQGTLVTVSS

SEQ ID NO: 6842 - protein, 125 aa, Artificial Sequence
  Description of Artificial Sequence: Synthetic polypeptide
  MOD_RES (2)..(2): Any amino acid
  MOD_RES (78)..(78): Any amino acid
QXQLVQSGGGVVQPGESLRLSCAVSGFSFDRNYWICWIRQAPGKGLEWAACISAGGSGNTYYATWAKGRFTISKTSSXTTVYLQMNSLRAEDTAVYFCARFYSGGGYYAGYFTLWGQGTLVTVSS

SEQ ID NO: 6843 - protein, 121 aa, Artificial Sequence
  Description of Artificial Sequence: Synthetic polypeptide
WGPGLVKPSQSLSLTCAVSGASVSSGINYWSWIRLYPGKGLEWIGYVYSSGTTYYNPSLKSRVSISLDTSKNQFSLNLRSVTAADTAVYYCARDRGDSSGSSYYKYYMDVWGKGTTVTVSS

SEQ ID NO: 6844 - protein, 125 aa, Artificial Sequence
  Description of Artificial Sequence: Synthetic polypeptide
  MOD_RES (1)..(1): Any amino acid
  MOD_RES (78)..(78): Any amino acid
XQSLEESGGDLVKPGASLTLTCTVSGFSFDRNYWICWIRQAPGMGLEWAACISAGGSGNTYYATWAKGRFTISKTSSXTTVTLQMASLTAADTATYFCARFYSGGGYYAGYFTLWGPGTLVTVSS

SEQ ID NO: 6845 - protein, 127 aa, Artificial Sequence
  Description of Artificial Sequence: Synthetic polypeptide
MESHTQVFVYMLLWLSGVEGDIVMTQSHKFMSTSVGDRVSITCKASQNVGTAVAWYQQKPGQSPKVLIYWASTRHTGVPDRFTGSGSGTDFTLTISNVQSEDLADYFCQQYSSYPLTFGAGTKLELK

SEQ ID NO: 6846 - protein, 127 aa, Artificial Sequence
  Description of Artificial Sequence: Synthetic polypeptide
MESQTQVFIYMLLWLSGVEGDIVMTQSHKFMSTSLGDRVNITCKASLAVGTAVAWYQQKPGQSPKLLIYWASTRPTGVPSRFTGSGSGTDFTLTISNVQSEDLTDFFCQQYSSYPLTFGAGTKLELK

SEQ ID NO: 6847 - protein, 127 aa, Artificial Sequence
  Description of Artificial Sequence: Synthetic polypeptide
MKSHTQVFIYMLLWLSGVEGDIVMTQSHKFMSTSVGDRVSITCKASQDVGTAVAWYQQKPGQSPKLLIYWASTRHTGVPDRFTGSRSGTDFTLTISNVQSEDLADYFCQQYSSYPCTFGGGAKLEIR

SEQ ID NO: 6848 - protein, 132 aa, Artificial Sequence
  Description of Artificial Sequence: Synthetic polypeptide
METDTLLLWVLLLWVPGSTGDIVLTQSPASLAVSLGQRATISCRASESVDSYGNSFVHWYQQKPGQPPKLLIYRASNLESGIPARFSGSGSRTDFTLTINPVEADDVATYYCLQSNEDPMYTFGGGTKLEIK

SEQ ID NO: 6849 - protein, 127 aa, Artificial Sequence
  Description of Artificial Sequence: Synthetic polypeptide
MRVPAQLLGLLLLWLPGARCDIVMTQSHKFMSTSVGDRVSITCKASQDVGTAVAWYQQKPGQSPKLLIYWASTRHTGVPDRFTGSRSGTDFTLTISNVQSEDLADYFCQQYSSYPLTFGGGAKLEIR

SEQ ID NO: 6850 - protein, 127 aa, Artificial Sequence
  Description of Artificial Sequence: Synthetic polypeptide
MRVPAQLLGLLLLWLPGARCDIVMTQSHKFMSTSVGDRVSITCKASQDVGTAVAWYQQKPGQSPKLLIYWASTRHTGVPDRFTGSRSGTDFTLTISNVQSEDLADYFCQQYSSYPSTFGGGAKLEIR

SEQ ID NO: 6851 - protein, 127 aa, Artificial Sequence
  Description of Artificial Sequence: Synthetic polypeptide
MRVPAQLLGLLLLWLPGARCDIVMTQSHKFMSTSVGDRVSITCKASQDVGTAVAWYQQKPGQSPKLLIYWASTRHTGVPDRFTGSRSGTDFTLTISNVQSEDLADYFCQQYSSYPATFGGGAKLEIR

SEQ ID NO: 6852 - protein, 127 aa, Artificial Sequence
  Description of Artificial Sequence: Synthetic polypeptide
  MOD_RES (116)..(116): Any amino acid
MRVPAQLLGLLLLWLPGARCDIVMTQSHKFMSTSVGDRVSITCKASQDVGTAVAWYQQKPGQSPKLLIYWASTRHTGVPDRFTGSRSGTDFTLTISNVQSEDLADYFCQQYSSYPXTFGGGAKLEIR

SEQ ID NO: 6853 - protein, 109 aa, Artificial Sequence
  Description of Artificial Sequence: Synthetic polypeptide
AFQLTQSPSSLSASVGDRVTINCQASQSIGGNLAWYQQKPGKAPKLLIYLASYLASGVPSRFSGSGSGTQFTLTVSSLQPEDFATYYCQSSYYSPNDNAFGQGTKVEIK

SEQ ID NO: 6854 - protein, 216 aa, Artificial Sequence
  Description of Artificial Sequence: Synthetic polypeptide
AFQLTQSPSSLSASVGDRVTINCQASQSIGGNLAWYQQKPGKAPKLLIYLASYLASGVPSRFSGSGSGTQFTLTVSSLQPEDFATYYCQSSYYSPNDNAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 6855 - protein, 125 aa, Artificial Sequence
  Description of Artificial Sequence: Synthetic polypeptide
QVQLVQSGGGVVQPGESLRLSCAASGFSFDRNYWMAWVRQAPGKGLEWAAVIAAGGSGNTYYATWAKGRFTISKDNSKNTVYLQMNSLRAEDTAVYFCARFYSGGGYYAGYFTLWGQGTLVTVSS

SEQ ID NO: 6856 - protein, 109 aa, Artificial Sequence
  Description of Artificial Sequence: Synthetic polypeptide
AFQLTQSPSSLSASVGDRVTITCQASQSIGNNLAWYQQKPGKAPKLLIYLASYLASGVPSRFSGSGSGTDFTLTISSLQPEDFATYYCQSAYYSPNDNAFGQGTKVEIK

SEQ ID NO: 6857 - protein, 109 aa, Artificial Sequence
  Description of Artificial Sequence: Synthetic polypeptide
AFQLTQSPSSLSASVGDRVTIFCQASQSIGNNLAWYQQKPGKAPKLLIYLASYLASGVPSRFSGSGSGTQFTLTVSSLQPEDFATYYCQSAYYSPNDNAFGQGTKVEIK

SEQ ID NO: 6858 - protein, 109 aa, Artificial Sequence
  Description of Artificial Sequence: Synthetic polypeptide
AFELTQTTSPVSAAVGGTVTIFCQASQSIGNNLAWYQQKPGQPPKLLIYLASYLASGVPSRFKGSGSGTQFTLTVSALECADAAAYYCQSAYYSPNDNAFGGGTEVVVR

SEQ ID NO: 6859 - protein, 109 aa, Artificial Sequence
  Description of Artificial Sequence: Synthetic polypeptide
AIQLTQSPSSLSASVGDRVTITCQASQSIGNNLAWYQQKPGKAPKLLIYLASYLASGVPSRFSGSGSGTDFTLTISSLQPEDFATYYCQSSYYSPNDNAFGQGTKVEIK

SEQ ID NO: 6860 - protein, 109 aa, Artificial Sequence
  Description of Artificial Sequence: Synthetic polypeptide
AFQLTQSPSSLSASVGDRVTITCQASQSIGNNLAWYQQKPGKAPKLLIYLASYLASGVPSRFSGSGSGTDFTLTISSLQPEDFATYYCQSSYYSPNDNAFGQGTKVEIK

SEQ ID NO: 6861 - protein, 109 aa, Artificial Sequence
  Description of Artificial Sequence: Synthetic polypeptide
AFQLTQSPSSLSASVGDRVTINCQASQSIGNNLAWYQQKPGKAPKLLIYLASYLASGVPSRFSGSGSGTQFTLTVSSLQPEDFATYYCQSSYYSPNDNAFGQGTKVEIK

SEQ ID NO: 6862 - protein, 109 aa, Artificial Sequence
  Description of Artificial Sequence: Synthetic polypeptide
AFQLTQSPSSLSASVGDRVTINCQASQSIGANLAWYQQKPGKAPKLLIYLASYLASGVPSRFSGSGSGTQFTLTVSSLQPEDFATYYCQSSYYSPNDNAFGQGTKVEIK

SEQ ID NO: 6863 - protein, 105 aa, Artificial Sequence
  Description of Artificial Sequence: Synthetic polypeptide
VMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 6864 - protein, 109 aa, Artificial Sequence
  Description of Artificial Sequence: Synthetic polypeptide
AFELTQTPASVEAAVGGTVTINCQASQSIGNNLAWYQQKPGQPPKLLIYLASYLASGVSSRFKGSGSGTQFTLTVSALECADAATYYCQSSYYSPNDNAFGGGTEVVVR

SEQ ID NO: 6865 - protein, 109 aa, Artificial Sequence; identical to SEQ ID NO: 6858
  Description of Artificial Sequence: Synthetic polypeptide

SEQ ID NO: 6866 - protein, 140 aa, Artificial Sequence
  Description of Artificial Sequence: Synthetic polypeptide
MEFGLSWLFLVAILKGVQCEVQLLEAGGGLVQPGGSLRLSCAASGFTFSSSAMSWVRQAPGKGLEWVSVISISGGSTYYADSVKGRFTISRDNSKNTLNLQMNSLRAEDTAVYYCAKETRYYYSYGMDVWGQGTTVTVSS

SEQ ID NO: 6867 - protein, 140 aa, Artificial Sequence
  Description of Artificial Sequence: Synthetic polypeptide
MELGLRWVFLVAILEGVQCEVQLVESGGGLVKPGGSLRLSCAASGFTFSSYSMNWVRQAPGKGLEWVSSISSSRSFIYYADSVKGRFTISRDIAKNSLSLQMSSLRVEDTAVYYCARERRYYYSYGLDVWGQGTTVTVSS

SEQ ID NO: 6868 - protein, 129 aa, Artificial Sequence
  Description of Artificial Sequence: Synthetic polypeptide
MDMRVPAQLLGLLLLWLPGARCAIQLTQSPSSLSASVGDRVTITCRASQRIGFALAWYQQKPGKAPKLLIHDASSLETGVPSRFSGSGSGTDFTLAISSLQPEDFATYYCQQFNTYPFTFGPGTKVDIK

SEQ ID NO: 6869 - protein, 140 aa, Artificial Sequence
  Description of Artificial Sequence: Synthetic polypeptide
MELGLSWIFLLAILKGVQCEVQLVESGGGLVQPGRSLRLSCAASGFTFDDYAIHWVRQAPGKGLEWVSGISWNGRSIGYADSVKGRFTISRDNAKNSLYLQMNSLRAEDTALYYCAKDIGFYGSGSLDYWGQGTLVTVSS

SEQ ID NO: 6870 - protein, 140 aa, Artificial Sequence; identical to SEQ ID NO: 6869
  Description of Artificial Sequence: Synthetic polypeptide

SEQ ID NO: 6871 - protein, 129 aa, Artificial Sequence; identical to SEQ ID NO: 6868
  Description of Artificial Sequence: Synthetic polypeptide

SEQ ID NO: 6872 - protein, 129 aa, Artificial Sequence
  Description of Artificial Sequence: Synthetic polypeptide
MDMRVPAQLLGLLLLWLPGARCAIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK

SEQ ID NO: 6873 - protein, 140 aa, Artificial Sequence
  Description of Artificial Sequence: Synthetic polypeptide
MELGLRWVFLVAILEGVQCEVQLVESGGGLVKSGGSLRLSCAASGFTLSSYSMNWVRQAPGKGLEWVSSISSSSSYIYYADSVKGRFTISRDIAKNSLSLQMSSLRAEDTAVYYCARERRYYYSYGMDVWGQGTTVTVSS

SEQ ID NO: 6874 - protein, 128 aa, Artificial Sequence
  Description of Artificial Sequence: Synthetic polypeptide
MEAPAQLLFLLLLWLPDTTGEIVLTQSPATLSLSPGERATLSCRASQSVSSYLAWYQQKPGQAPRLLIYDASNRATGIPARFSGSGSGTDFTLTISSLEPEDFAVYYCQQRSNWPALTFGGGTKVEIK

SEQ ID NO: 6875 - protein, 128 aa, Artificial Sequence; identical to SEQ ID NO: 6874
  Description of Artificial Sequence: Synthetic polypeptide

SEQ ID NO: 6876 - protein, 114 aa, Artificial Sequence
  Description of Artificial Sequence: Synthetic polypeptide
LESGPGLVKPSETLSLTCTVSGYSISSGYYWGWIRQPPGKGLGWIGSIYHSGSTYYNPSLKSRVTISVDTSKNQFSLKLSSVTAADTAVYYCARDSSYNGFDPWGQGTLVTVSS

SEQ ID NO: 6877 - protein, 108 aa, Artificial Sequence
  Description of Artificial Sequence: Synthetic polypeptide
DIKMTQSPSSMYASLGERVTITCKASQDIKSYLSWYQQKPWKSPKTLIYYAKNLADGVPSRFSGSGFGQDYSLTISSLESDDTATYYCLQHGESPYTFGSGTKLEIKR

SEQ ID NO: 6878 - protein, 112 aa, Artificial Sequence
  Description of Artificial Sequence: Synthetic polypeptide
NIMMTQSPSSLAVSAGGKVTMSCKSSQSVLYSSNQKNYLAWYQQKPGQSPKLLIYWASTRESGVPDRFTGSGSGTDFTLTISSVQAEDLAVYYCHQYLSSWTFGGGTKLEIK

SEQ ID NO: 6879 - protein, 119 aa, Artificial Sequence
  Description of Artificial Sequence: Synthetic polypeptide
SDVQLQESGPGLVKPSQSLSLTCSVTGYSITSGFYLNWIRQFPGNKLEWMGYINYGGSINYNPSLKSRISITRDTSKNQFFLRLNSVTAEDTATYYCATMPNSWYFDVWGTGTTVTVSS

SEQ ID NO: 6880 - protein, 118 aa, Artificial Sequence
  Description of Artificial Sequence: Synthetic polypeptide
DVQLQESGPGLVKPSQTLSLTCTVSGYSITSGFYLNWIRQHPCKGLEWIGYINYGGSINYNPSLKSRVTISRDTSKNQFSLKLSSVTAADTAVYYCATMPNSWYFDVWGRGTLVTVSS

SEQ ID NO: 6881 - protein, 118 aa, Artificial Sequence
  Description of Artificial Sequence: Synthetic polypeptide
DVQLQESGPGLVKPSQTLSLTCTVSGYSITSGFYLNWIRQHPGKKLEWIGYINYGGSINYNPSLKSRVTISRDTSKNQFSLKLSSVTAADTAVYYCATMPNSWYFDVWGTGTLVTVSS

SEQ ID NO: 6882 - protein, 118 aa, Artificial Sequence
  Description of Artificial Sequence: Synthetic polypeptide
EVQLVESGPGLVKPSQTLSLTCTVSGYSITSGFYLNWVRQHPGKKLEWIGYINYGGSINYNPSLKSRVSISRDTSKNQFSLKLTSVTAADTAVYYCATMPNSWYFDVWGTGTLVTVSS

SEQ ID NO: 6883 - protein, 119 aa, Artificial Sequence
  Description of Artificial Sequence: Synthetic polypeptide
DVQLQESGPGLVKPSQTLSLTCTVSGYSITSGFYLNWIRQHPGKKLEWIGYINYGGSINYNPSLKSRVTISRDTSKNQFSLKLSSVTAADTAVYYCARTMPNSWYFDVWGTGTLVTVSS

SEQ ID NO: 6884 - protein, 106 aa, Artificial Sequence
  Description of Artificial Sequence: Synthetic polypeptide
ELTQSPGTLSLSPGERATLSCRASQSISSSFLAWYQQKPGQAPRLLIYSASSRATGTPDRFSGSGSGTDFTLTISRLEPEDFAVYYCQQYATSLRTFGQGTKVEIK

SEQ ID NO: 6885 - protein, 120 aa, Artificial Sequence
  Description of Artificial Sequence: Synthetic polypeptide
QIQLVQSGPELKKPGETVKISCKASGYTFTRYGMSWVKQAPGKGLKWMGWINTYSGVPTYADDFKGRFAFSLETSASTAYLQINNLKNEDTATYFCARRGYSNYYPMDFWGQGTSVTVSS

SEQ ID NO: 6886 - protein, 122 aa, Artificial Sequence
  Description of Artificial Sequence: Synthetic polypeptide
EVMLVESGGGLVKPGGSLQLSCAASGFTFSDYAMSWVRQTAETRLEWVATISDGGSHTYYPDSVRGRFTISRDNAKKALYLEMSSLKSEDTAMYYCGRRAGRYDERDAMDYWGQGTTVTVSS

SEQ ID NO: 6887 - protein, 107 aa, Artificial Sequence
  Description of Artificial Sequence: Synthetic polypeptide
SIVMTQTPKFLPVSAGDRVTMTCKASQSVGNNVAWYQQKSGQSPKLLIYYASNRYTGVPDRFTGSGSGTDFTFTISSVQVEDLAVYFCQQHYSSPPTFGAGTKLELK

SEQ ID NO: 6888 - protein, 107 aa, Artificial Sequence
  Description of Artificial Sequence: Synthetic polypeptide
DIKMTQSPSSMYASLGERVTITCKASQDIKSYLSWYQQKPWKSPKTLIYYAKNLADGVPSRFSGSGFGQDYSLTISSLESDDTATYYCLQHGESPYTFGSGTKLEIK

SEQ ID NO: 6889 - protein, 112 aa, Artificial Sequence
  Description of Artificial Sequence: Synthetic polypeptide
NIMMTQSPDSLAVSLGERATINCKSSQSVLYSSNQKNYLAWYQQKPGQPPKLLIYWASTRESGVPDRFSGSGSGTDFTLTISSLQAEDVAVYYCHQYLSSWTFGQGTKVEIK

SEQ ID NO: 6890 - protein, 112 aa, Artificial Sequence
  Description of Artificial Sequence: Synthetic polypeptide
NIMMTQSPDSLAVSLGERATINCKSSQSVLYSSNQKNYLAWYQQKPGQSPKLLIYWASTRESGVPDRFSGSGSGTDFTLTISSLQAEDVAVYYCHQYLSSWTFGGGTKVEIK

SEQ ID NO: 6891 - protein, 112 aa, Artificial Sequence
  Description of Artificial Sequence: Synthetic polypeptide
NIMMTQSPDSLALSLGERATINCKSSQSVLYSSNQKNYLAWYQQKPGQSPKLLIYWASSRESGVPDRFSGSGSGTDFTLTISSLQAEDVALYYCHQYLSSWTFGGGTKVEIK

SEQ ID NO: 6892 - protein, 120 aa, Artificial Sequence
  Description of Artificial Sequence: Synthetic polypeptide
LEQSGAEVKKPGENLKISCEASGYNFVNHWIGWVRQMPGRGLEWMGRIYPGDSETRFSPSFQGQVTISVDKTLSTASLQWNSLKTSDSATYYCVTLGRWSSWQGGALSWGQGTRVIVSSA

SEQ ID NO: 6893 - protein, 119 aa, Artificial Sequence
  Description of Artificial Sequence: Synthetic polypeptide
LESGGGVVQPGRSLRLSCAASGFTFSTYGMHWVRQAPGKGLEWVAVVSYDGTKEYYSDSVKGRFTISRDNSKKMVYLQMNSLRAEDTAVYYCAKEPPRRGFYWYFDYWGQGTLVTVSSA

SEQ ID NO: 6894 - protein, 112 aa, Artificial Sequence
  Description of Artificial Sequence: Synthetic polypeptide
ELTQSPDSLAVSLGERATINCKSSQSILSTSKNKNYLAWYQQKPGQPPKLLIYWASTREDGVPDRFSGSGAGTDFSLTISSLQAEDVAVYYCQQRRSWPPTFGQGTKLEIKR

SEQ ID NO: 6895 - protein, 106 aa, Artificial Sequence
  Description of Artificial Sequence: Synthetic polypeptide
ELTQSPSSLSASVGDRVTITCRASQDISNYLAWFQQRPGKVPNLLIYAASTLQSGVPSRFSGSGSGTEFTLTISSLQPEDGASYYCQKYDGAPWTFGQGTKVEIKR

SEQ ID NO: 6896 - protein, 125 aa, Artificial Sequence
  Description of Artificial Sequence: Synthetic polypeptide
QVQLQESGPGLVKPSQTLSLTCTVSGGSIRSGDYFWSWIRQSPGKGLECIGYISYSGTTYCNPSLQRRVTISVDTSKNQFNLKLKSVTAADTAVYYCARTVDSGYDFIPDWFHPWGQGTLVTVSS

SEQ ID NO: 6897 - protein, 110 aa, Artificial Sequence
  Description of Artificial Sequence: Synthetic polypeptide
QPGLTQPPSASGTPGQRITISCSGSNSNIGNSYVHWYQQLPGTAPKLLIQRNNQRPSGVPDRFFGSKSGTSASLAISGLRSEDEADYYCAAWADSLGTYVFGTGTKLTVL

SEQ ID NO: 6898 - protein, 152 aa, Artificial Sequence
  Description of Artificial Sequence: Synthetic polypeptide
MGWTWIFILILSVTTGVHSEVQLQQSGPELEKPGASVKLSCKASGYSFTGYNMNWVKQSHGKSLEWIGHIDPYYGDTSYNQKFRGKATLTVDKSSSTAYMQLKSLTSEDSAVYYCVKGGYYGHWYFDVWGAGTTVTVSSATTTAPSVYPLVP

SEQ ID NO: 6899 - protein, 144 aa, Artificial Sequence
  Description of Artificial Sequence: Synthetic polypeptide
MDMRAPAQILGFLLLLFPGTRCDIQMTQSPSSLSASLGERVSLTCRASQDIGSSLNWLQQGPDGTIKRLIYATSSLDSGVPKRFSGSRSGSDYSLTISSLESEDFVDYYCLQYVSSPPTFGAGTKLELKRADAAPTVFIFGRIP

SEQ ID NO: 6900 - protein, 118 aa, Artificial Sequence
  Description of Artificial Sequence: Synthetic polypeptide
VQLQESGGDLVKPGGSLKLSCAASGFTFSIYTMSWLRQTPEKRLEWVATLSGDGDDIYYPDSVKGRFTISRDNAKNNLYLQMNSLRSADTALYYCARVRLGDWDFDVWGPGTTVSVSS

SEQ ID NO: 6901 - protein, 111 aa, Artificial Sequence
  Description of Artificial Sequence: Synthetic polypeptide
VQLQESGPELVKPGASVKMSCRASGYTFTEYVITWVKQRTGQGLEWIGEIYPGSGSTSYNEKFKGKATLTADKSSNTAYMHLSSLTSEDSAVYFCTREDLGGQGTLVTVSS

SEQ ID NO: 6902 - protein, 111 aa, Artificial Sequence
  Description of Artificial Sequence: Synthetic polypeptide
VQLQQSGAEVKKPGSSVKVSCKASGYTFTEYVITWVKQRPGQGLEWIGEIYPGSGSTSYNEKFKGKATITADKSTNTAYMELSSLRSEDTAFYFCTREDLGGQGSLVTVSS

SEQ ID NO: 6903 - protein, 224 aa, Artificial Sequence
  Description of Artificial Sequence: Synthetic polypeptide
KVQLVESGAEVKKPGASVKVSCKASGYTFTSYDINWVRQATGQGLEWMGWMNPNSGNTGYAQKFQGRVTMTRNTSISTAYMELSSLRSEDTAVYYCARGKGSGYYNYWGQGTLVTVSSASTKGPSVFLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTS

SEQ ID NO: 6904 - protein, 226 aa, Artificial Sequence
  Description of Artificial Sequence: Synthetic polypeptide
EVQLVESGAEVKKPGASVKVSCKASGYTFTSYDINWVRQATGQGLEWMGWMNPNSGNTGYAQKFQGRVTMTRNTSISTAYMELSSLRSEDTAVYYCARGRGFDWLKNFDYWGQGTLVTVSPASTKGPVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 6905 - protein, 112 aa, Artificial Sequence
  Description of Artificial Sequence: Synthetic polypeptide
AVLMTQTPLSLPVSLGDQASISCRSSQSIVHSNGNTYLEWYLQKPGQSPKLLIYKVSNRFSGVPDRFSGTGSGTDFTVRISRVEAEDLGLYYCFQGSRVPYTFGGGTKLEIK

SEQ ID NO: 6906 - protein, 111 aa, Artificial Sequence
  Description of Artificial Sequence: Synthetic polypeptide
DIQLTQSPGTLSLSPGERATLSCRSSQSIVHSNGNTYLEWYLQKPGQAPRLLIYKVSNRFSGVPDRFSGSGSGTDFTLTISRLEPEDFAVYYCFQGSRVPYTFGGGTKVEI

SEQ ID NO: 6907 - protein, 113 aa, Artificial Sequence
  Description of Artificial Sequence: Synthetic polypeptide
DIVMSQSPSSLAVSPGEKVTMTCKSSQSLFNSRTRKNYLGWYQQKPGQSPKLLIYWASTRESGVPDRFTGSGSGTDFTLTINSVQSEDLAVYYCTQVYYLCTFGAGTKLELKR

SEQ ID NO: 6908 - protein, 214 aa, Artificial Sequence
  Description of Artificial Sequence: Synthetic polypeptide
QLALTQPPSVSGSPGQSITISCTGTSSDVGGYNYVSWYQQHPGKAPKLMIYDVSNRPSGVSNRFSGSKSGNTASLTISGLQAEDEADYYCCSYAGSSTLVFGGGTKLTVLGQPKAAPSVTLFPPSSELQANKATLVCLISDFYPGAVTVAWKADGSPVKAGVETTTPSKQSNNKYAASSYLSLTPEQWKSHRSYSCQVTHEGSTVEKTVAPTEC

SEQ ID NO: 6909 - protein, 215 aa, Artificial Sequence
  Description of Artificial Sequence: Synthetic polypeptide
ELVLTQSPATLSLSPGERATLSCGASQSVSSSYLAWYQQKPGQAPRLLIYGASSRATGIPDRFSGSGSGTDFTLTISRLEPEDFAVYYCQQYGSSPPVTFGQGTRLEIKRTVAAPSVFIFPPSDEQLSGTASVVCLLNNFYPREAKVQWKVDNALQSGNSQESVTEQDSKDSTYSLSSTLTLSKADYEKHKVYACEVTHQGLSLPVTKSFNRGEC

SEQ ID NO: 6910 - protein, 261 aa, Artificial Sequence
  Description of Artificial Sequence: Synthetic polypeptide
AQPAMAEVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARLHAQTWGQGTLVTVSSGGGGSGGGGSGGSALQSVLTQPPSVSAAPGQKVTISCSGSSSDMGNYAVSWYQQLPGTAPKLLIYENNKRPSGIPDRFSGSKSGTSATLGITGLWPEDEADYYCLAWDTSPRNVFGGGTKLTVLGAAAHHHHHHGAAEQKL

SEQ ID NO: 6911 - protein, 247 aa, Artificial Sequence
  Description of Artificial Sequence: Synthetic polypeptide
DIVMSQSPSSLAVSPGEKVTMTCKSSQSLFNSRTRKNYLGWYQQKPGQSPKLLIYWASTRESGVPDRFTGSGSGTDFTLTINSVQSEDLAGGSGGGGSEVQLQESGGDLVKPGGSLKLSCAASGFTFSIYTMSWLRQTPEKRLEWVATLSVYYCTQVYYLCTFGAGTKLELKRGGGGSGGGDGDDIYYPDSVKGRFTISRDNAKNNLYLQMNSLRSADTALYYCARVRLGDWDFDVWGQGTTVTVSS

SEQ ID NO: 6912 - protein, 272 aa, Artificial Sequence
  Description of Artificial Sequence: Synthetic polypeptide
EVQLVESGGGLVQPGGSLRLSCAASGSTRSVNPMAWFRQAPGRQREWVATISRSGYATYADSVKGRFTISGDNAKSSVYLQMNSLKPEDTAVYYCVTGTYWGQGTLVTVSSGGGGSGGGGSGGGGSGGGGSGGGGSGGGGSGGGGSGGGGSEVQLVESGGGLVQPGGSLRLSCAASGSIFSINNMGWYRQAPGKQRELVTVVTSNLITTYADSVKGRFTISRDNAKNTVYLQMNSLKPEDTAVYYCNAWARSVGSVPYSQFWGQGTLVTVSS

SEQ ID NO: 6913 - protein, 283 aa, Artificial Sequence
  Description of Artificial Sequence: Synthetic polypeptide
EVQLVESGGGLVQAGGSLRLSCAASRLTFNHYNMGWFRQAPGKERERVAEVTWSGDKIYYVDSVKGRFTISRDNTPNPVYLYLQMNSLKPEDTAVYYCATAPRGLPYANGYWGQGTLVTVSSGGGGSGGGGSGGGGSGGGGSGGGGSGGGGSGGGGSGGGGSEVQLVESGGGLVQPGGSLRLSCAASGSIFSINTMGWYRQAPGKQRDLVASITMNQVPNYADSVQGRFTISRDNVRNTVHLQMNAVKPEDTADYFCNAWVRSSGASPYTNYWGQGTLVTVSS

SEQ ID NO: 6914 - protein, 272 aa, Artificial Sequence
  Description of Artificial Sequence: Synthetic polypeptide
EVQLVESGGGLVQPGGSLRLSCAASGSIFSINTMGWYRQAPGKQRELVSTITSNLVPHYADSVQGRFTISRDNARNTVYLQMNSLKPQDTAHYYCNAWARSSGATPYTNYWGQGTLVTVSSGGGGSGGGGSGGGGSGGGGSGGGGSGGGGSGGGGSGGGGSEVQLVESGGGLVQPGGSLRLSCAASGSTRSVNPMAWFRQAPGRQREWVATISRSGYATYADSVKGRFTISGDNAKSSVYLQMNSLKPEDTAVYYCVTGTYWGQGTLVTVSS

SEQ ID NO: 6915 - protein, 272 aa, Artificial Sequence
  Description of Artificial Sequence: Synthetic polypeptide
EVQLVESGGGLVQPGGSLRLSCAASGSTRSVNPMAWFRQAPGRQREWVATISRSGYATYADSVKGRFTISGDNAKSSVYLQMNSLKPEDTAVYYCVTGTYWGQGTLVTVSSGGGGSGGGGSGGGGSGGGGSGGGGSGGGGSGGGGSGGGGSEVQLVESGGGLVQPGDSLRLSCAASGRILSINNMVWYRQAPGKQRELVAHITSSGSTGYADSVKGRFTISRDNAKNTFYLQMTNLNPEDTAVYYCNCWVSSDSNAPLKNYWGQGTLVTVSS

SEQ ID NO: 6916 - protein, 286 aa, Artificial Sequence
  Description of Artificial Sequence: Synthetic polypeptide
EVQLVESGGGLVQPGGSLRLSCAASGSTLDYYAIGWFRQAPGKEREGVSCTSNSGSTYYGGSVKGRFTASRDNAKNTVYLQMNSLRPEDTAVYYCVATIGCATLGGTLDVQRYYYRGQGTLVTVSSGGGGSGGGGSGGGGSGGGGSGGGGSGGGGSGGGGSGGGGSEVQLVESGGGLVQAGGSLRLSCTASGRTLSSYTMGWFRQAPGTEREFVAAMTRSGFNTYYADSVKGRFTISRDSTENTMALQMSSLKPEDTAVYYCTAGRGLTSYRADYWGQGTLVTVSS

SEQ ID NO: 6917 - protein, 286 aa, Artificial Sequence
  Description of Artificial Sequence: Synthetic polypeptide
EVQLVESGGGLVQAGGSLRLSCTASGRTLSSYTMGWFRQAPGREREFVAAMTRSGFNTYYADSVKGRFTISRDSTENTMALQMSSLKPEDTAVYYCTAGRGLTSYRADYWGQGTLVTVSSGGGGSGGGGSGGGGSGGGGSGGGGSGGGGSGGGGSGGGGSEVQVLESGGGLVQPGGSLRLSCAASGSTLDYYAIGWFRQAPGKEREGVSCTSNSGSTYYGGSVKGRFTASRDNAKNTVYLQMNSLPREDTAVYYCVATIGCATLGGTLDVQRYYYRGQGTLVTVSS

SEQ ID NO: 6918 - protein, 277 aa, Artificial Sequence
  Description of Artificial Sequence: Synthetic polypeptide
EVQLVESGGGLVQAGGSLRLSCAASGNTFSTNPMYWYRQAEGKQRELVASISSRGITNYADSVRGRFSISRDNTKDTVYLQMNSLKPEDTAVYYCRLASLSSGTVYWGKGTLVTVSSGGGGSGGGGSGGGGSGGGGSGGGGSGGGGSGGGGSGGGGSEVQLVESGGGLVQAGGSLRLSCTASGRTLSSYTMGWFRQAPGTEREFVAAMTRSGFNTYYADSVKGRFTISRDSTENTMALQMSSLKPEDTAVYYCTAGRGLTSYRADYWGQGTLVTVSS

SEQ ID NO: 6919 - protein, 280 aa, Artificial Sequence
  Description of Artificial Sequence: Synthetic polypeptide
EVQLVESGGGLVQPGGSLRLSCAASGSFGDNYELYAMTWFRQAPGERRDFVASVTGDGSTSYADSVKFRFTISRDNAKKLMYLQMNSLKPEDTAVYYCRLLNYWGQGTLVTVSSGGGGSGGGGSGGGGSGGGGSGGGGSGGGGSGGGGSGGGGSEVQLVESGGGLVQPGGSLRLSCAASGSTLDYYAIGWFRQAPGKEREGVSCTSNSGSTYYGGSVKGRFTASRDNAKNTVYLQMNSLRPEDTAVYYCVATIGCATLGGTLDVQRYYYRGQGTLVTVSS

SEQ ID NO: 6920 - protein, 282 aa, Artificial Sequence
  Description of Artificial Sequence: Synthetic polypeptide
EVQLVESGGGLVQAGGSLRLSCTASGRTLSSYTMGWFRQAPGTEREFVAAMTRSGFNTYYADSVKGRFTISRDSTENTMALQMSSLKPEDTAVYYCTAGRGLTSYRADYWGQGTLVTVSSGGGGSGGGGSGGGGSGGGGSGGGGSGGGGSGGGGSGGGGSEVQLVESGGGLVQAGGSLRLSCAASRLTFNHYNMGWFRQAPGKERERVAEVTWSGDKIYYVDSVKGRFTISRDNTPNPVYLYLQMNSLKPEDTAVYYCATAPRGLPYANGYWGQGTLVTVSS

SEQ ID NO: 6921 - protein, 271 aa, Artificial Sequence
  Description of Artificial Sequence: Synthetic polypeptide
EVQLVESGGGLVQPGGSLRLSCAASGSTRSVNPMAWFRQAPGRQREWVATISRSGYATYADSVKGRFTISGDNAKSSVYLQMNSLKPEDTAVYYCVTGTYWGQGTLVTVSSGGGGSGGGGSGGGGSGGGGSGGGGSGGGGSGGGGSGGGGSEVQLVESGGGLVQAGGSLRLSCTASGRTLSSYTMGWFRQAPGTEREFVAAMTRSGFNTYYADSVKGRFTISRDSTENTMALQMSSLKPEDTAVYYCTAGRGLTSYRADYWGQGTLVTVSS

SEQ ID NO: 6922 - protein, 278 aa, Artificial Sequence
  Description of Artificial Sequence: Synthetic polypeptide
EVQLVESGGGLVQPGGSLRLSCAASGSIFSINTMGWYRQAPGKQRELVSTITSNLVPHYADSVQGRFTISRDNARNTVYLQMNSLKPQDTAHYYCNAWARSSGATPYTNYWGQGTLVTVSSGGGGSGGGGSGGGGSGGGGSGGGGSGGGGSGGGGSGGGGSEVQLVESGGGLVQAGGSLRLSCAASGNTFSTNPMYWYRQAEGKQRELVASISSRGITNYADSVRGRFSISRDNTKDTVYLQMNSLKPEDTAVYYCRLASLSSGTVYWGKGTLVTVSS

SEQ ID NO: 6923 - protein, 283 aa, Artificial Sequence
  Description of Artificial Sequence: Synthetic polypeptide
EVQLVESGGGLVQAGGSLRLSCAASGNTFSTNPMYWYRQAEKGQRELVASISSRGITNYADSVRGRFSISRDNTKDTVYLQMNSLKPEDTAVYYCRLASLSSGTVYWGKGTLVTVSSGGGGSGGGGSGGGGSGGGGSGGGGSGGGGSGGGGSGGGGSEVQLVESGGGLVQPGGSLRLSCAASGSTLDYYAIGWFRQAPGKEREGVSCTSNSGSTYYGGSVKGRFTASRDNAKNTVYLQMNSLRPEDTAVYYCVATIGCATLGGTLDVQRYYYRGQGTLVTVSS

SEQ ID NO: 6924 - protein, 288 aa, Artificial Sequence
  Description of Artificial Sequence: Synthetic polypeptide
EVQLVESGGGLVQPGGSLRLSCAASGSTLDYYAIGWFRQAPGKEREGVSCTSNSGSTYYGGSVKGRFTASRDNAKNTVYLQMNSLRPEDTAVYYCVATIGCATLGGTLDVQRYYYRGQGTLVTVSSGGGGSGGGGSGGGGSGGGGSGGGGSGGGGSGGGGSGGGGSEVQLVESGGGLVQAGGSLRLSCAASRLTFNHYNMGWFRQAPGKERERVAEVTWSGDKIYYVDSVKGRFTISRDNTPNPVYLYLQMNSLKPEDTAVYYCATAPRGLPYANGYWGQGTLVTVSS

SEQ ID NO: 6925 - protein, 278 aa, Artificial Sequence
  Description of Artificial Sequence: Synthetic polypeptide
EVQVLESGGGLVQAGGSLRLSCAASGNTFSTNPMYWYRQAEGKQRELVASISSRGITNYADSVRGRFSISRDNTKDTVYLQMNSLKPEDTAVYYCRLASLSSGTVYWGKGTLVTVSSGGGGSGGGGSGGGGSGGGGSGGGGSGGGGSGGGGSGGGGSEVQLVESGGGLVQPGGSLRLSCAASGSIFSINNMGWYRQAPGKQRELVTVVTSNLITTYADSVKGRFTISRDNAKNTVYLQMNSLKPEDTAVYYCNAWARSVGSVPYSQFWGQGTLVTVSS

SEQ ID NO: 6926 - protein, 278 aa, Artificial Sequence
  Description of Artificial Sequence: Synthetic polypeptide
EVQVLESGGGLVQAGGSLRLSCAASGNTFSTNPMYWYRQAEGKQRELVASISSRGITNYADSVRGRFSISRDNTKDTVYLQMNSLKPEDTAVYYCRLASLSSGTVYWGKGTLVTVSSGGGGSGGGGSGGGGSGGGGSGGGGSGGGGSGGGGSGGGGSEVQLVESGGGLVQPGDSLRLSCAASGRILSINNMVWYRQAPGKQRELVAHITSSGSTGYADSVKGRFTISRDNAKNTFYLQMTNLNPEDTAVYYCNCWVSSDSNAPLKNYWGQGTLVTVSS

SEQ ID NO: 6927 - protein, 279 aa, Artificial Sequence
  Description of Artificial Sequence: Synthetic polypeptide
EVQLVESGGGLVQAGGSLRLSCAASRLTFNHYNMGWFRQAPGKERERVAEVTWSGDKIYYVDSVKGRFTISRDNTPNPVYLYLQMNSLKPEDTAVYYCATAPRGLPYANGYWGQGTLVTVSSGGGGSGGGGSGGGGSGGGGSGGGGSGGGGSGGGGSGGGGSEVQLVESGGGLVQAGGSLRLSCAASGNTFSTNPMYWYRQAEGKQRELVASISSRGITNYADSVRGRFSISRDNTKNTVYLQMNSLKPEDTAVYYCRLASLSSGTVYWGKGTLVTVSS

SEQ ID NO: 6928 - protein, 278 aa, Artificial Sequence
  Description of Artificial Sequence: Synthetic polypeptide
EVQVLESGGGLVQAGGSLRLSCAASGNTFSTNPMYWYRQAEGKQRELVASISSRGITNYADSVRGRFSISRDNTKDTVYLQMNSLKPEDTAVYYCRLASLSSGTVYWGKGTLVTVSSGGGGSGGGGSGGGGSGGGGSGGGGSGGGGSGGGGSGGGGSEVQLVESGGGLVQPGGSLRSLCAASGRIFSINTMGWYRQAPGKQRELVAGVTINAITNYADSVKGRFTISRDNAKNTVWLQMNSLKPEDTAVYYCHAWARSSGSAPYSQNWGQGTLVTVSS

SEQ ID NO: 6929 - protein, 281 aa, Artificial Sequence
  Description of Artificial Sequence: Synthetic polypeptide
EVQLVESGGGLVQAGGSLRLSCAASGRTFSSYIMGWFRQAPGKAREVFADITWGQRPYYADSVKGRFTISRDNAKNTVYLEMNSLKPEDTAVYYCAADLGVVIREEHAYWGQGTLVTVSSGGGGSGGGGSGGGGSGGGGSGGGGSGGGGSGGGGSGGGGSEVQLVESGGGLVQPGGSLRLSCAASGSIFSINTMGWYRQAPGKQRELVSTITSNLVPHYADSVQGRFTISRDNARNTVYLQMNSLKPQDTAHYYCNAWARSSGATPYTNYWGQGTLVTVSS

SEQ ID NO: 6930 - protein, 281 aa, Artificial Sequence
  Description of Artificial Sequence: Synthetic polypeptide
EVQLVESGGGLVQAGGSLRLSCTASGRTLSSYTMGWFRQAPGTEREFVAAMTRSGFNTYYADSVKGRFTISRDSTENTMALQMSSLKPEDTAVYYCTAGRGLTSYRADYWGQGTLVTVSSGGGGSGGGGSGGGGSGGGGSGGGGSGGGGSGGGGSGGGGSEVQLVESGGGLVQPGGSLRLSCAASGRIFSINTMGWYRQAPGKQRELVAGVTINAITNYADSVKGRFTISRDNAKNTVWLQMNSLKPEDTAVYYCHAWARSSGSAPYSQNWGQGTLVTVSS

SEQ ID NO: 6931 - protein, 277 aa, Artificial Sequence
  Description of Artificial Sequence: Synthetic polypeptide
EVQLVESGGGLVQPGGSLRLSCAASGSTRSVNPMAWFRQAPGRQREWVATISRSGYATYADSVKGRFTISGDNAKSSVYLQMNSLKPEDTAVYYCVTGTYWGQGTLVTVSSGGGGSGGGGSGGGGSGGGGSGGGGSGGGGSGGGGSGGGGSEVQLVESGGGLVQPGGSLRLSCAASGSTLDYYAIGWFRQAPGKEREGVSCTSNSGSTYYGGSVKGRFTASRDNAKNTVYLQMNSLRPEDTAVYYCVATIGCATLGGTLDVQRYYYRGQGTLVTVSS

SEQ ID NO: 6932 - protein, 278 aa, Artificial Sequence
  Description of Artificial Sequence: Synthetic polypeptide
EVQLVESGGGLVQAGGSLRLSCAASGNTFSTNPMYWYRQAEGKQRELVASISSRGITNYADSVRGRFSISRDNTKDTVYLQMNSLKPEDTAVYYCRLASLSSGTVYWGKGTLVTVSSGGGGSGGGGSGGGGSGGGGSGGGGSGGGGSGGGGSGGGGSEVQLVESGGGLVQPGGSLRLSCAASGSIFSINTMGWYRQAPGKQRELVSTITSNLVPHYADSVQGRFTISRDNARNTVYLQMNSLKPQDTAHYYCNAWARSSGATPYTNYWGQGTLVTVSS

SEQ ID NO: 6933 - protein, 277 aa, Artificial Sequence
  Description of Artificial Sequence: Synthetic polypeptide
EVQLVESGGGLVQPGGSLRLSCAASGSTLDYYAIGWFRQAPGKEREGVSCTSNSGSTYYGGSVKGRFTASRDNAKNTVYLQMNSLRPEDTAVYYCVATIGCATLGGTLDVQRYYYRGQGTLTVTSSGGGGSGGGGSGGGGSGGGGSGGGGSGGGGSGGGGSGGGGSEVQLVESGGGLVQPGGSLRLSCAASGSTRSVNPMAWFRQAPGRQREWVATISRSGYATYADSVKGRFTISGDNAKSSVYLQMNSLKPEDTAVYYCVTGTYWGQGTLVTVSS

SEQ ID NO: 6934 - protein, 287 aa, Artificial Sequence
  Description of Artificial Sequence: Synthetic polypeptide
EVQLVESGGGLVQPGGSLRLSCAASGSTLDYYAIGWFRQAPGKEREGVSCTSNSGSTYYGGSVKGRFTASRDNAKNTVYLQMNSLRPEDTAVYYCVATIGCATLGGTLDVQRYYYRGQGTLVTVSSGGGGSGGGGSGGGGSGGGGSGGGGSGGGGSGGGGSGGGGSEVQLVESGGGLVQPGGSLRLSCAASGSIFSINNMGWYRQAPGKQRELVTVVTSNLITTYADSVKGRFTISRDNAKNTVYLQMNSLKPEDTAVYYCNAWARSVGSVPYSQFWGQGTLVTVSS

SEQ ID NO: 6935 - protein, 280 aa, Artificial Sequence
  Description of Artificial Sequence: Synthetic polypeptide
EVQLVESGGGLVQAGGSLRLSCAASGRTFSSYIMGWFRQAPGKAREFVADITWGQRPYYADSVKGRFTISRDNAKNTVYLEMNSLKPEDTAVYYCAADLGVVIREEHAYWGQGTLVTVSSGGGGSGGGGSGGGGSGGGGSGGGGSGGGGSGGGGSGGGGSEVQLVESGGGLVQAGGSLRLSCTASGRTLSSYTMGWFRQAPGTEREFVAAMTRSGFNTYYADSVKGRFTISRDSTENTMALQMSSLKPEDTAVYYCTAGRGLTSYRADYWGQGTLVTVSS

SEQ ID NO: 6936 - protein, 103 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 6937 - protein, 107 aa, Artificial Sequence [sequence omitted]

SEQ ID NO: 6938 - protein, 569 aa, Artificial Sequence
  Description of Artificial Sequence: Synthetic polypeptide
EEQVVESGGGFVQPGGSLRLSCAASGFTFSPYWMHWVRQAPGKGLVWVSRINSDGSTYYADSVKGRFTISRDNARNTLYLQMNSLRAEDTAVYYCARDRYYGPEMWGQGTMVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 6939 - protein, 154 aa, Artificial Sequence
  Description of Artificial Sequence: Synthetic polypeptide
QVQLVESGGGVVQPGRSLRLSCAASGFTFSSYGMHWVRQAPGKGLEWVAAIWYSGSNKYYADSVKGRFTISRDNSKNTLYLQMNSLRAEDTAVYYCARDPHYTRGFDYWGKGTLVTVSSASTKGPIGLPLAPCSRSTSESTAALGCLVKDYFAE

SEQ ID NO: 6940 - protein, 119 aa, Artificial Sequence; identical to SEQ ID NO: 3105
  Description of Artificial Sequence: Synthetic polypeptide

SEQ ID NO: 6941 - protein, 124 aa, Artificial Sequence
  Description of Artificial Sequence: Synthetic polypeptide
QVQLVESGGGVVQPGGSLRLSCAASGFTFSTAGMHWVRQAPGKGLEWVAVIWYNGKEISYADSVKGRFTVSRDNPKNTLYLQMSSLRTEDTAVYYCARNRGDIYYDFTYAMDIWGQGTMVTVSS

SEQ ID NO: 6942 - protein, 124 aa, Artificial Sequence
  Description of Artificial Sequence: Synthetic polypeptide
QVQLVESGGGVVQPGRSLRLSCTASGFSFSSYGMHWVRQAPGKGLEWVAVIWYNGKEISYADSVKGRFTVSRDNPKNTLYLQMSSLRTEDTAVYYCARNRGDIYYDFTYAMDIWGQGTMVTVSS

SEQ ID NO: 6943 - protein, 124 aa, Artificial Sequence
  Description of Artificial Sequence: Synthetic polypeptide
QVQLVESGGGLVQPGRSLRLSCVGSGFTFSSYGIHWVRQAPGKGLEWVAVIWYNGKEISYADSVKGRFTVSRDNLKNTLYLQMSSLRTEDTAVYYCARNRGDIYYDFTYAMDIWGQGTMVTVSS

SEQ ID NO: 6944 - protein, 124 aa, Artificial Sequence
  Description of Artificial Sequence: Synthetic polypeptide
QVQLVESGGGLVQPGRSLRLSCVGSGFTFSSYGIHWVRQAPGKGLEWVAVIWYNGKEISYADSVKGRFTVSRDNPKNTLYLQMSSLRTEDTAVYYCARNRGDIYYDFTYAMDIWGQGTMVTVSS

SEQ ID NO: 6945 - protein, 50 aa, Artificial Sequence
  Description of Artificial Sequence: Synthetic polypeptide
EVQLVESGGGVVQPGGSLRLSCAASGFTFSTAGMHWVRQAPGKGLEWVAV

SEQ ID NO: 6946 - protein, 121 aa, Artificial Sequence
  Description of Artificial Sequence: Synthetic polypeptide
QVQLQQPGAELVKPGASVKLSCKASGYSFTSYWMHWVKQRPGQGLEWIGEINPSNGRTNYNEKFNTKATLTVDTSSSTAYMQLSSLTSEDSAVYYCVLYGNYVVYYTMDYWGQGTSVTVSS

SEQ ID NO: 6947 - protein, 120 aa, Artificial Sequence
  Description of Artificial Sequence: Synthetic polypeptide
DVQLQESGPGLVKPSQSLSLTCTVTGYSITSDYAWNWIRQFPGNKLEWMGYITYNGDTSYNPSLKSRISIARDTSKNQFFLQLNSVTTEDTATYSCAGSRNYYGAWFAYWGQGTLVTVSA

SEQ ID NO: 6948 - protein, 115 aa, Artificial Sequence
  Description of Artificial Sequence: Synthetic polypeptide
QVQLVQSGAEVKKPGASVKVSCKASGYSFTSYWMHWVRQAPGQGLEWMGEINPSNGRTNYNEKFNTRVTMTRDTSTSTVYMELSSLRSEDTAVYYCVLYGNYVVYYTMDYWGQGT

SEQ ID NO: 6949 - protein, 135 aa, Artificial Sequence
  Description of Artificial Sequence: Synthetic polypeptide
MMVLSLLYLLTAIPGILSDVQLQESGPGLVKPSQSLSLPCSVTGYSITSGYYWNWIRQFPGNKLEWMGYIRYDGNNNYNPSLKNRISITHDTSKNQFFLKLNYVTTEDTATYYCARGLQFYFDSWGQGTTLTVSS

SEQ ID NO: 6950 - protein, 137 aa, Artificial Sequence
  Description of Artificial Sequence: Synthetic polypeptide
MNFGLSLVFLVLILKGVQCEVMLVESGGGLVKPGGSLKLSCAASGFTFSTFTMSWVRQTPEKRLECVATINGGGGNTYYPDSVKGRFTISRDNAKNNLYLQMSSLRSEDTAFYFCSRLYGIYAMDYWGQGTSVTVSS

SEQ ID NO: 6951 - protein, 117 aa, Artificial Sequence
  Description of Artificial Sequence: Synthetic polypeptide
DVQLQESGPGLVKPSETLSLTCSVTGYSITSGYYWNWIRQPPGKGLEWMGYIRYDGNNNYNPSLKNRITISHDTSKNQFSLKLSSVTAADTATYYCARGLQFYFDSWGQGTTVTVSS

SEQ ID NO: 6952 - protein, 118 aa, Artificial Sequence
  Description of Artificial Sequence: Synthetic polypeptide
EVMLVESGGGLVQPGGSLRLSCAASGFTFSTFTMSWVRQAPGKGLECVATINGGGGNTYYPDSVKGRFTISRDNSKNTLYLQMNSLRAEDTAFYFCSRLYGIYAMDYWGQGTTVTVSS

SEQ ID NO: 6953 - protein, 137 aa, Artificial Sequence
  Description of Artificial Sequence: Synthetic polypeptide
MDWTWRVFFLLAVAPGAHSQVRLVQSGTEVKKPGASVRVSCKASGYTFSNYYMYWVRQAPGQGLEWMAMINPSGGSTRYAQKFQGRVTMTRDTSTSTVYMELSSLRSEDTAVYYCARADSGSYFGYWGQGTLVTVSS

SEQ ID NO: 6954 - protein, 467 aa, Artificial Sequence
  Description of Artificial Sequence: Synthetic polypeptide
MDWTWRVFCLLAVAPGAHSQVRLVQSGTEVKKPGASVRVSCKASGYTFSNYYMYWVRQAPGQGLEWMAMINPSGGSTRYAQKFQGRVTMTRDTSTSTVYMELSSLRSEDTAVYYCARADSGSYFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 6955 - protein, 107 aa, Artificial Sequence
  Description of Artificial Sequence: Synthetic polypeptide
DIQMTQSPSTLSASVGDRVTITCRASQSISSWLAWYQQKPGKAPKLLIYKASSLESGVPSRFSGSGSGTEFTLTISSLQPDDFATYYCQQYKSYPVFGQGTKVEIKG

SEQ ID NO: 6956 - protein, 118 aa, Artificial Sequence
  Description of Artificial Sequence: Synthetic polypeptide
QVRLQQSGPGLVKPSETLSLTCTVSGGSTSPYFWSWLRQPPGKGLEWIGYIHSNGGTNYNPSLKSRLTISGDTSKNQFSLNLSFVTAADTALYYCARTDYDVYGPAFDIWGQGTMVTV

SEQ ID NO: 6957 - protein, 118 aa, Artificial Sequence
  Description of Artificial Sequence: Synthetic polypeptide
QVQLQQSGPGRVKPSETLSLTCTVSGYSVSSGYYWGWIRQSPGTGLEWIGSISHSGSTYYNPSLKSRVTISGDASKNQFFLRLTSVTAADTAVYYCARSEATANFDSWGRGTLVTVSS

SEQ ID NO: 6958 - protein, 119 aa, Artificial Sequence
  Description of Artificial Sequence: Synthetic polypeptide
QVQLQQSGPGLVKPSETLSLTCTVSGGSVSSSGYYWTWIRQPPGKGLEWIGSIYSSGSTYYSPSLKSRVTISGDTSKNQFSLKLSSVTAADTAVYYCARLNWGTVSAFDIWGRGTLVTV

SEQ ID NO: 6959 - protein, 119 aa, Artificial Sequence
  Description of Artificial Sequence: Synthetic polypeptide
EVQLLESGGGLVQPGGSLRLSCSASGFTFSRYPMHWVRQAPGKGLEYVSDIGTNGGSTNYADSVKGRFTISRDNSKNTVYLQMSSLRAEDTAVYHCVAGIAAAYGFDVWGQGTMVTVSS

SEQ ID NO: 6960 - protein, 118 aa, Artificial Sequence
  Description of Artificial Sequence: Synthetic polypeptide
QVQLVQSGGGLVQPGGSLRLSCSASGFTFSSYPMHWVRQAPGKGLDYVSDISPNGGSTNYADSVKGRFTISRDNSKNTLFLQMSSLRAEDTAVYYCVMGLVPYGFDIWGQGTLVTVSS

SEQ ID NO: 6961 - protein, 118 aa, Artificial Sequence
  Description of Artificial Sequence: Synthetic polypeptide
QMQLVQSGGGLVQPGGSLRLSCSASGFTFSSYPMHWVRQAPGKGLDYVSDISPNGGATNYADSVKGRFTISRDNSKNTVYLQMSSLRAEDTAVYYCVMGLVPYGFDNWGQGTMVTVSS

SEQ ID NO: 6962 - protein, 119 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSS

SEQ ID NO: 6963 - protein, 116 aa, Artificial Sequence
  Description of Artificial Sequence: Synthetic polypeptide
EVQLVQSGADVKKPGASVRVTCKASGYTFTGHNIHWVRQAPGQGLEWMGWINPDSGATSYAQKFQGRVTMTRDTSITTAYMDLSRLRSDDTAVYYCATDTLLSNHWGQGTLVTVSS

SEQ ID NO: 6964 - protein, 123 aa, Artificial Sequence
  Description of Artificial Sequence: Synthetic polypeptide
EVQLVESGGGLVQPGGSLRLSCAASGYTFSSYATSWVRQAPGKGLEWVAGISGSGDTTDYVDSVKGRFTVSRDNSKNTLYLQMNSLRADDTAVYYCASRGGLGGYYRGGFDFWGQGTMVTVSS

SEQ ID NO: 6965 - protein, 120 aa, Artificial Sequence
  Description of Artificial Sequence: Synthetic polypeptide
QVQLVESGGGVVEPGRSLRLSCAASGFTFSNYGMHWVRQAPGKGLDWVAVISSHGRDKYYADSVKGRFTISRDYSRNMVYLQMNSLRPEDTAVYYCAKDKGVKYSYGDSWGRGTLVTVSS

SEQ ID NO: 6966 - protein, 120 aa, Artificial Sequence
  Description of Artificial Sequence: Synthetic polypeptide
QVQLVESGGGVVQPGRSLRLSCAASGFTFSSHGMHWVRQAPGKGLEWVAAVSNDGSDKYYADSVKGRLTISRDNSENTLYLQMSSLRGEDTAVYYCAKGSIAARQYFDYWGQGTLVTVSS

SEQ ID NO: 6967 - protein, 120 aa, Artificial Sequence
  Description of Artificial Sequence: Synthetic polypeptide
QVQLVESGGGVVQPGRSQRLSCVASGFIFNNYAMHWVRQAPGKGLEWVAAISFDGRDKFYADSVQGRFSISRDNSRDTLYLQMNGLRPDDTAVYFCATGSKEAHQFVLYWAQGTLVTVSS

SEQ ID NO: 6968 - protein, 120 aa, Artificial Sequence
  Description of Artificial Sequence: Synthetic polypeptide
QVQLVESGGGVVRPGRSLRLSCAASGFTFSSHGMHWVRQAPGKGLEWVAAVSNDGSDKYYADSVKGRLTISRDNSENTLYLQMSSLRGEDTAVYYCAKGSIAARQYFDCWGQGTLVTVSS

SEQ ID NO: 6969 - protein, 114 aa, Artificial Sequence
  Description of Artificial Sequence: Synthetic polypeptide
QVQLQESGPGLVKPSETLSLTCTVSGDSINTEGYYWSWIRQPAGRGLEWIGRIYKGGNIIYNPSLKSRVTIALDTSKSQFSLRLTSVTAADTAVYYCARIPGPWGQGTLVTVSS

SEQ ID NO: 6970 - protein, 120 aa, Artificial Sequence
  Description of Artificial Sequence: Synthetic polypeptide
QVQLQESGPGLVKPSQTLSLTCTVSGASISSSGYCWGWVRQPPGKGLEWIGYICYSANAYYNPSLKSRVTISVGTSGQHFSLKLSSVTAADTAVYYCARSRSMSFPGDDWGQGTLVTVSS

SEQ ID NO: 6971 - protein, 124 aa, Artificial Sequence
  Description of Artificial Sequence: Synthetic polypeptide
QVQLVESGGGLVQPGGSLRLSCSTSGFSFSTSGMHWVRQAPGKGLEYVAAITGDGANTYYAKSVTGRFTVSRDNSKTTLYLQMSSLRTEDTAVYYCARAPAQHNTIWYGPDDYWGQGTLVTVSS

SEQ ID NO: 6972 - protein, 116 aa, Artificial Sequence
  Description of Artificial Sequence: Synthetic polypeptide
EVQLVESGGGLVQPGGSLRLSCAASGFPFSRYWMHWVRQAPGKGLEWVSRSNPDAITTYYADSVKGRFTISRDNAKNTLYLQMDTVRAEDTAVYYCVTFTDDRGYWGQGTLVTVSS

SEQ ID NO: 6973 - protein, 120 aa, Artificial Sequence
  Description of Artificial Sequence: Synthetic polypeptide
QVQLVESGGGVVQPGRSLRLSCAASGFTFSDYGMHWVRQTPGRGLEWVAIISNDGHNALYADSVRGRFTISRDNARDTLYVEMSSLRPEDTAIYYCAKSVDIMGYYLDYWGQGTLVTVSS

SEQ ID NO: 6974 - protein, 117 aa, Artificial Sequence
  Description of Artificial Sequence: Synthetic polypeptide
EVQLVETGGGLIQPGGSLRLSCAVSGFNVNNNHMNWVRQAPGKGLEWLSLIYSGDKTYTADSVKGRFTISRDTSKNTLYLQMNSLGVEDTAVYYCATALLFFNGGHWGQGTLVTVSS

SEQ ID NO: 6975 - protein, 120 aa, Artificial Sequence
  Description of Artificial Sequence: Synthetic polypeptide
QVQLQQSGPRLVKPSQTLSLTCAISGDTLFTKSVAWNWLRQSPSGGLEWLGRTDYTSKWNTDYAPSVRSRITINADTSKNLFSLQLDFVTPQDTAIYYCARGIHSTFDFWGQGTLVTVSS

SEQ ID NO: 6976 - protein, 121 aa, Artificial Sequence
  Description of Artificial Sequence: Synthetic polypeptide
QVQLQQSGPGLVKPSQTLSLTCAISGDSVSRSSSVAWNWIRLSPSRGLEWLGRTYYRSQWYNDYAVSVNGRVSVNPDTSKNQFSLHLNSVTPEDTAVYYCVRGQHSAFDIWGQGTMVTVSS

SEQ ID NO: 6977 - protein, 121 aa, Artificial Sequence
  Description of Artificial Sequence: Synthetic polypeptide
QVQLVESGGGVVQPGRSLRLSCSASGFTFRSHGMHWVRQAPGKGLEWVAMISYDVTTTKYADSVKGRVTLSRDNSRNTVYLQMDSLRPEDSAVYYCARGLNDYDDYRLAYWGQGTLVTVSS

SEQ ID NO: 6978 - protein, 116 aa, Artificial Sequence
  Description of Artificial Sequence: Synthetic polypeptide
QVQLQESGPGLVKTSETLSLTCIVSGGSMTNYYLSWLRKPPGKGLEWIGYIYYNGDTTIYNPSLRSRVTMSVETFKSQFSLRLNSVTAADTAVYYCARHRGAFDTWGQGTMVTVSS

SEQ ID NO: 6979 - protein, 118 aa, Artificial Sequence
  Description of Artificial Sequence: Synthetic polypeptide
EVQLVESGGGLVQPGRSLTLSCVVSGFYSDDYAMHWVRQAPGKGLEWVSGIMWKSGNTGYVDSVKGRFTISRDSAKNSLYLQMNSLRPEDTALYYCAKDTSAGSPIMGGQGTLVTVSS

SEQ ID NO: 6980 - protein, 118 aa, Artificial Sequence
  Description of Artificial Sequence: Synthetic polypeptide
EVQLVQSEAEMKKPGESLRISCKASGYKFTSSWIGWARQMPDKGLEWMAIINPRDSDTRYSPSLQGQVTISVDKSISTVYLQWSSLKASDTAIYYCARQPGEGWFDPWGQGTLVTVSS

SEQ ID NO: 6981 - protein, 131 aa, Artificial Sequence
  Description of Artificial Sequence: Synthetic polypeptide
EVQLVESGGGLVQPGGSLRLSCSASGFTDSRFTFRNYWMHWVRQAPGKGLVWVSRINGDGGGTVYSDSVKGRFTISRDNARNIVYLQMDSLRAEDTAVYYCVREFGLFDSGTWYSGGFDYWGQGTLVTVSS

SEQ ID NO: 6982 - protein, 128 aa, Artificial Sequence
  Description of Artificial Sequence: Synthetic polypeptide
EVQLVESGGGLVQPGGSLRLSCAASGFTIPFRKYWLHWVRQAPGKGLVWVSLIIGDGSSTNYADSVKGRFTISRDNDKNTLYLQMNSLRVEDTAVYYCARDLGERTGDNWHSLGPDYWGQGTLVTVSS

SEQ ID NO: 6983 - protein, 124 aa, Artificial Sequence; identical to SEQ ID NO: 6971
  Description of Artificial Sequence: Synthetic polypeptide

SEQ ID NO: 6984 - protein, 115 aa, Artificial Sequence
  Description of Artificial Sequence: Synthetic polypeptide
EVQLVESGGGLVQPGGSLRLSCAASGFTFSGFWMSWVRQAPGRGLEWVANIKEDGSLKNYVDSVKGRFTISRDNAENSLFLQMNSLRAEDTAVYYCCSSAWCTYWGQGTLVTVSS

SEQ ID NO: 6985 - protein, 120 aa, Artificial Sequence
  Description of Artificial Sequence: Synthetic polypeptide
QVQLQESGPGLVKPSETLSLTCTVSGGSISSYYWSWIRQPAGKGLEWIGRIYTSGNTNYKPSLKSRVTMSVDTSKNQFSLKLSSVTAADTAVYYCAREVMVRGVTFDYWGQGTLVTVSSA

SEQ ID NO: 6986 - protein, 118 aa, Artificial Sequence
  Description of Artificial Sequence: Synthetic polypeptide
QVQLQESGPGLVKPSETLSLTCTVSGGSVSDYYWSWIRQPPGKGLEWIGYIYYSGSTNYNPSLKSRVTISVDTSKNQFSLKLSSVTAADTAVYYCARDGSVPPGIYWGQGTLVTVSSA

SEQ ID NO: 6987 - protein, 123 aa, Artificial Sequence
  Description of Artificial Sequence: Synthetic polypeptide
QVQLVESGGGVVQPGRSLRLSCAASGFTFRYGMHWVRQAPGKGLEWVAVIWYDGNKKYHAESVKGRFTISRDNSKNTLYLQMNSLRAEDTAVYYCARGGFGELPHLYGMDVWGQGTTVTVSSA

SEQ ID NO: 6988 - protein, 122 aa, Artificial Sequence
  Description of Artificial Sequence: Synthetic polypeptide
EVQLVESGGGLVKPGGSLRLSCAVSGFTFSNAWMSWVRQTPGKGLEWVGRIKSKTDGGTIDYAAPVKGRFTISRDDSKNTLYLQMNSLKTEDTAVYYCTKFYYGSGSYGYWGQGTINTVSSA

SEQ ID NO: 6989 - protein, 121 aa, Artificial Sequence
  Description of Artificial Sequence: Synthetic polypeptide
QVQLQQSGPGLVKPSQTLSLTCAISGDSVSSNSAAWNWIRQSPSRGLEWLGRTYYRSKWYNDYAVSVKSRITINPDTSKNQFSLQLNSVTPEDTAVYYCARGYYYGMDVWGQGTTVTVSSA

SEQ ID NO: 6990 - protein, 123 aa, Artificial Sequence
  Description of Artificial Sequence: Synthetic polypeptide
EVQLVESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTYYYDSSGYYYYWGQGTLVTVSSA

SEQ ID NO: 6991 - protein, 122 aa, Artificial Sequence
  Description of Artificial Sequence: Synthetic polypeptide
EVQLVQSGAEVKKPGESLKISCKGFGYSFASYWIGWVRQMPGKGLEWMGNIYPGDSYTIYSPSFQGQVAISADKSISTAYLQWNSLKASDTAMYYCARRGFSGRSYDAFEIWGQGTMVTVLA

SEQ ID NO: 6992 - protein, 125 aa, Artificial Sequence
  Description of Artificial Sequence: Synthetic polypeptide
QVHLQESGPGLVKPSETLSLTCTVSGGSITNFYWSWIRQSAGKGLEWIGRIYISGTTNYNPSLKSRVTMSLDTSKNQFSLKLSSVTAADTAVYYCARGGYSIGWYRDLGSFDIWGQGTMVTVSSA

SEQ ID NO: 6993 - protein, 117 aa, Artificial Sequence
  Description of Artificial Sequence: Synthetic polypeptide
QVQLQESGPGLVKPSESLSLTCTVSGGSVSSYYWSWIRQPAGKGLEWIGLIYTSGSTNYNPSLKSRVTMSVDTSKNQFSLKLSSVTAADSAVYYCARIAAAGTDYWGQGTLVTVSSA

SEQ ID NO: 6994 - protein, 124 aa, Artificial Sequence
  Description of Artificial Sequence: Synthetic polypeptide
EIQLVQSGAEVKKPGASVKVSCKASGYTFTDHAISWVRQAPGQGLEWMGWISPYSGNPNYAQSLQGRVSLTTDRSTRTAYMELRSLKSDDTAVYYCARNRGDIYYDFTYAFDIWGQGTMVTVSS

SEQ ID NO: 6995 - protein, 124 aa, Artificial Sequence
  Description of Artificial Sequence: Synthetic polypeptide
EVQLVESGGGVVQPGGSLRLSCAASGFTFSTAGMHWVRQAPGKGLEWVAVIWYNGKEISYADSVKGRFTVFRDNPKNTLYLQMSSLRTEDTAVYYCARNRGDIYYDFTYAMDIWGQGTMVTVSS

SEQ ID NO: 6996 - protein, 124 aa, Artificial Sequence; identical to SEQ ID NO: 6941
  Description of Artificial Sequence: Synthetic polypeptide

SEQ ID NO: 6997 - protein, 124 aa, Artificial Sequence; identical to SEQ ID NO: 6943
  Description of Artificial Sequence: Synthetic polypeptide

SEQ ID NO: 6998 - protein, 124 aa, Artificial Sequence; identical to SEQ ID NO: 6944
  Description of Artificial Sequence: Synthetic polypeptide

SEQ ID NO: 6999 - protein, 124 aa, Artificial Sequence; identical to SEQ ID NO: 6942
  Description of Artificial Sequence: Synthetic polypeptide

SEQ ID NO: 7000 - protein, 124 aa, Artificial Sequence
  Description of Artificial Sequence: Synthetic polypeptide
QVQLVESGGGVVQPGRSLRLSCAASGFTFSSYPLHWVRQAPGKGLEWVSFISYDGSEKYYASSVKGRFTISRDNSENTLYLQMNSLRPEDTAVYYCARNRGDIYYDFTYAMDIWGQGTMVTVSS

SEQ ID NO: 7001 - protein, 124 aa, Artificial Sequence
  Description of Artificial Sequence: Synthetic polypeptide
EVQLVESGGGLVQPGRSLRLSCVGSGFTFSSYGIHWVRQAPGKGLEWVANIWYDGSSESYIDSVKGRFTVSRDDSRNTVYLQMNSLRPEDTAVYYCARNRGDIYYDFTYAMDIWGQGTMVTVSS

SEQ ID NO: 7002 - protein, 124 aa, Artificial Sequence
  Description of Artificial Sequence: Synthetic polypeptide
EVQLVESGGGVVQPGRSLRLSCAASGFTFSSYGMHWVRQAPGKGLEWVAVIWYDGYNKDYADSVKGRFTISRDNSKNTLYLQINSLRAEDTAVYYCARNRGDIYYDFTYAMDIWGQGTMVTVSS

SEQ ID NO: 7003 - protein, 124 aa, Artificial Sequence
  Description of Artificial Sequence: Synthetic polypeptide
EVQLVESGGGVVQPGRSLRLSCAASGFTFSNYPMHWVRQAPGKGLEWVAVISYDGSEKWYADSVKGRFTISRDNSKNTLYLEMNSLRPEDTAVYYCARNRGDIYYDFTYAMDIWGQGTTVTVSS

SEQ ID NO: 7004 - protein, 107 aa, Artificial Sequence
  Description of Artificial Sequence: Synthetic polypeptide
DIQLTQSPSTLSASVGDSVTITCRASEGVDRWLAWYQQKPGRAPKLLIYDASTLQSGVPSRFSGSGSGTEFSLTISSLQPDDVATYYCQHFWGTPYTFGQGTKLEIK

SEQ ID NO: 7005 - protein, 124 aa, Artificial Sequence
  Description of Artificial Sequence: Synthetic polypeptide
EVQLVESGGGVVQPGRSLRLSCAASGFTFSNYPMHWVRQAPGKGLEWVAVISYDGSEKWYADSVKGRFTISRDNSKNTLYLEMNSLRPEDTAVYYCARNRGDIYYDFTYAMDQWGQGTTVTVSS

SEQ ID NO: 7006 - protein, 124 aa, Artificial Sequence
  Description of Artificial Sequence: Synthetic polypeptide
EVQLVESGGGVVQPGRSLRLSCAASGFTFSSYPLHWVRQAPGKGLEWVSFISYDGSEKYYASSVKGRFTISRDNSENTLYLQMNSLRPEDTAVYYCARNRGDIYYDFTYAMDIWGQGTMVTVSS

SEQ ID NO: 7007 - protein, 124 aa, Artificial Sequence
  Description of Artificial Sequence: Synthetic polypeptide
EVQLVESGGGVVQPGRSLRLSCAASGFTFSNYPMHWVRQAPGKGLEWVAVISYDGSEKWYADSVKGRFTISRDNSKNTLYLEMNSLRPEDTAVYYCARNRGDIYYDFTYAMDYWGQGTTVTVSS

SEQ ID NO: 7008 - protein, 124 aa, Artificial Sequence
  Description of Artificial Sequence: Synthetic polypeptide
EMQLLESGGGLVQPGGSLRLSCAASGFTFSSYAMNWVRQAPGEGLEWVSAITISGITAYYTDSVKGRFTISRDNSKNTLYLQMNSLRAGDTAVYYCAKEEFLPGTHYYYGMDVWGQGTTVTVSS

SEQ ID NO: 7009 - protein, 124 aa, Artificial Sequence; identical to SEQ ID NO: 7008
  Description of Artificial Sequence: Synthetic polypeptide

SEQ ID NO: 7010 - protein, 107 aa, Artificial Sequence
  Description of Artificial Sequence: Synthetic polypeptide
AIQMTQSPSSLSASVGDRVTITCRASQGIRNDLGWYQQKPGKAPKLVIYSASTLQSGVPSRFSGSGSGTDFTLSISSLQPDDFATYYCLQDYNYPWTFGQGTKVEIK

SEQ ID NO: 7011 - protein, 124 aa, Artificial Sequence
  Description of Artificial Sequence: Synthetic polypeptide
EVQLLESGGGLVQPGGSLRLSCAASGFTFSSYAMNWVRQAPGKGLEWVSAITISGITAYYTDSVKGRFTISRDNSKNTLYLQMNSLRAEDTAVYYCAKEEFLPGTHYYYGMDVWGQGTTVTVSS

SEQ ID NO: 7012 - protein, 124 aa, Artificial Sequence
  Description of Artificial Sequence: Synthetic polypeptide
EVQLVESGGGLVQPGGSLRLSCSASGFIFSTHAMHWVRQTPGMGLEYVAAITNNGGGTYYAASVKGRFTVSRDNSKNTLFLQMNSLRPEDTAMYYCLKAPPPESGDLYGPDDYWGQGTLVTVSS

SEQ ID NO: 7013 - protein, 122 aa, Artificial Sequence
  Description of Artificial Sequence: Synthetic polypeptide
QVQLVESGGGVVPPGESLRVSCVGSGFTFNTAVLHWVRQPPGKGLEWVAAISHDGLGRFYADSVKGRFTISRDNSKNTLYLQMNNLSGDDTALYYCAKEEFTSGYCGAVGYWGEGTLVTVSS

SEQ ID NO: 7014 - protein, 154 aa, Artificial Sequence; identical to SEQ ID NO: 6939
  Description of Artificial Sequence: Synthetic polypeptide

SEQ ID NO: 7015 - protein, 124 aa, Artificial Sequence; identical to SEQ ID NO: 7000
  Description of Artificial Sequence: Synthetic polypeptide

SEQ ID NO: 7016 - protein, 124 aa, Artificial Sequence; identical to SEQ ID NO: 7003
  Description of Artificial Sequence: Synthetic polypeptide

SEQ ID NO: 7017 - protein, 124 aa, Artificial Sequence; identical to SEQ ID NO: 7007
  Description of Artificial Sequence: Synthetic polypeptide

SEQ ID NO: 7018 - protein, 124 aa, Artificial Sequence; identical to SEQ ID NO: 6994
  Description of Artificial Sequence: Synthetic polypeptide

SEQ ID NO: 7019 - protein, 116 aa, Artificial Sequence
  Description of Artificial Sequence: Synthetic polypeptide
EEQVVESGGGFVQPGGSLRLSCAASGFTFSPYWMHWVRQAPGKGLVWVSRINSDGSTYYADSVKGRFTISRDNARNTLYLQMNSLRAEDTAVYYCARDRYYGPEMWGQGTMVTVSS

SEQ ID NO: 7020 - protein, 138 aa, Artificial Sequence
  Description of Artificial Sequence: Synthetic polypeptide
GDDEATILADNKCMCTRVTSRIIPSTEDPNEDIVERNIRIVVPLNNRENISDPTSPLRRNFVYHLSDVCKKCDPVEVELEDQVVTATQSNICNEDDGVPETCYMYDRNKCYTTMVPLRYHGETKMVQAALTPDSCYPD

SEQ ID NO: 7021 - protein, 219 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7022 - protein, 127 aa, Artificial Sequence
  Description of Artificial Sequence: Synthetic polypeptide
DVVMTQTPLSLSVTPGQPASISCRSSQSLLHSDGMTYFSWYLQKPGQPPQLLIYEVSNRFSGVPDRFSGSGSGTDFTLKISRVEAEDVGVYYCMQNIQLPWTFGQGTKVEIKRTVAAPSVFIFPPSD

SEQ ID NO: 7023 - protein, 108 aa, Artificial Sequence; identical to SEQ ID NO: 3140
  Description of Artificial Sequence: Synthetic polypeptide

SEQ ID NO: 7024 - protein, 109 aa, Artificial Sequence
  Description of Artificial Sequence: Synthetic polypeptide
QIVLTQSPTIMSASLGEEITLTCSASTSVSYMEWYQQKSGTSPKILIYTTSKLASGVPSRFSGSGSGTFYSLTISSVEAEDAADYYCHQWRNYPFTFGSGTKLEIKRAD

SEQ ID NO: 7025 - protein, 110 aa, Artificial Sequence
  Description of Artificial Sequence: Synthetic polypeptide
DIVMTQSHKFMSTSIGDRVSINYKASQYVGTTVAWYQQKSGHSPKLLIYRASTRHTGVPDRFTGSGSGTDFTLNISNVQSEDLADYFCQQYCSSPLTFGAGTYLEVKRAD

SEQ ID NO: 7026 - protein, 106 aa, Artificial Sequence
  Description of Artificial Sequence: Synthetic polypeptide
DIQLTQSPSFLSASVGDRVTITCSASTSVSYMEWYQQKPGKAPKLLIYTTSKLASGVPSRFSGSGSGTEFTLTISSLQPEDFATYYCHQWRNYPFTFGQGTKLEIK

SEQ ID NO: 7027 - protein, 114 aa, Artificial Sequence
  Description of Artificial Sequence: Synthetic polypeptide
DIVMSQSPSSLAVSGGEKVTMSCKSSQSLLNGSYQKHTLAWYQQKPGQSPKLLIYWASTRESGVPDRFTGSGSGTDFTLTISSVKAEDLAVYYCQQYYSYPWTFGGGTKLEIKR

SEQ ID NO: 7028 - protein, 114 aa, Artificial Sequence
  Description of Artificial Sequence: Synthetic polypeptide
DIVMTQSPDSLAVSLGERATINCKSSQSLLNGSYQKHTLAWYQQKPGQPPKLLIYWASTRESGVPDRFTGSGSGTDFTLTISSLQAEDVAVYYCQQYYSYPWTFGQGTKLEIKR

SEQ ID NO: 7029 - protein, 128 aa, Artificial Sequence
  Description of Artificial Sequence: Synthetic polypeptide
MRVPAQLLGLLLLWLPGARCDIQLTQSPSFLSASVGDRVPITCRASQGISTHLAWYQQKPGKAPKLLIYAASTLQSGVPSRFSGSGSGTEFTLTISSLQPEDSATYYCQQLKSYPLTFGGGTKVEIKR

SEQ ID NO: 7030 - protein, 234 aa, Artificial Sequence
  Description of Artificial Sequence: Synthetic polypeptide
MRVPAQLLGLLLLWLPGARCDIQLTQSPSFLSASVGDRVPITCRASQGISTHLAWYQQKPGKAPKLLIYAASTLQSGVPSRFSGSGSGTEFTLTISSLQPEDSATYYCQQLKSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7031 - protein, 124 aa, Artificial Sequence
  Description of Artificial Sequence: Synthetic polypeptide
QAQLVQSGAEVKKPGASVKVSCKASGYTFIGYWMHWVRQAPGQGPEWMGRINPNSGGTKYVQKFQGRVTVTRDTSISTAYMELNWLTSDDTAVYYCARARPGCGGDCYEVLDYWGQGTLVTVSS

SEQ ID NO: 7032 - protein, 108 aa, Artificial Sequence; identical to SEQ ID NO: 3507
  Description of Artificial Sequence: Synthetic polypeptide

SEQ ID NO: 7033 - protein, 110 aa, Artificial Sequence
  Description of Artificial Sequence: Synthetic polypeptide
QAGLTQPASVSGSPGQSITISCTGTSSDIATYNYVSWYQQHPGKAPKLMIYEGTKRPSGVSNRFSGSKSGNTASLTISGLQAEDEADYYCSSYARSYTYVFGTGTELTVL

SEQ ID NO: 7034 - protein, 110 aa, Artificial Sequence
  Description of Artificial Sequence: Synthetic polypeptide
QTVVTQPASVSGSPGQSITISCTGTSSDVGGYNYVSWYQQHPGKAPKLMIYEVSNRPSGVSNHFSGSKSGNTASLTISGLQAEDEADYYCSSYTTSSTYVFGTGTKVTVL

SEQ ID NO: 7035 - protein, 110 aa, Artificial Sequence
  Description of Artificial Sequence: Synthetic polypeptide
QTVVTQPASVSASPGQSITISCAGTSGDVGNYNFVSWYQQHPGKAPKLLIYEGSQRPSGVSNRFSGSRSGNTASLTISGLQAEDEADYYCSSYARSYTYVFGTGTKLTVL

SEQ ID NO: 7036 - protein, 107 aa, Artificial Sequence
  Description of Artificial Sequence: Synthetic polypeptide
EIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7037 - protein, 108 aa, Artificial Sequence
  Description of Artificial Sequence: Synthetic polypeptide
SSELTQDPAVSVALGQTVRITCQGDSLRSYYTNWFQQKPGQAPLLVVYAKNKRPPGIPDRFSGSSSGNTASLTITGAQAEDEADYYCHSRDSSGNHVVFGGGTKLTVL

SEQ ID NO: 7038 - protein, 108 aa, Artificial Sequence
  Description of Artificial Sequence: Synthetic polypeptide
QSVLTQPASVSGSPGQSITISCTGTSSDVGGYNYVSWYQQHPGKAPKLMIYEVSNRPSGVSNRFSGSKSGNTASLTISGLQAEDEADYCSSYSSGTVVFGGGTELTVL

SEQ ID NO: 7039 - protein, 106 aa, Artificial Sequence
  Description of Artificial Sequence: Synthetic polypeptide
DIQLTQSPSFLSASVGDRVTITCRASQDIDIYLAWYQQKPGKAPNLLIYAASTLQSGVPLRFSGSGSGTEFTLTISSLQPEDFATYYCQQLTTYPLTFGGGTTVDI

SEQ ID NO: 7040 - protein, 107 aa, Artificial Sequence
  Description of Artificial Sequence: Synthetic polypeptide
DIQMTQSPSTLSASVGDRVTITCRASQSISTWLAWYQQKPGKAPELLIYKASNLESGVPSRFSSSGSGTEFTLTISSLQPDDFATYYCQQYDRYSLTFGGGTKVEIK

SEQ ID NO: 7041 - protein, 107 aa, Artificial Sequence
  Description of Artificial Sequence: Synthetic polypeptide
DIQMTQSPSTLSASVGDRVTITCRASQDVGIWLAWYQQKPGKAPNSLIYKTSSLHNGVPSRFSGSGYGTEFTLTISSLQPDDFATYYCQQHGAFPITFGQGTRLEIR

SEQ ID NO: 7042 - protein, 107 aa, Artificial Sequence
  Description of Artificial Sequence: Synthetic polypeptide
DIQMTQSPSTLSASVGDRVTITCRASQSISTWLAWYQQKPGKAPELLIYKASNLESGVPSRFSGSGSGTEFTLTISSLQPDDFATYYCQQYDRYSLTFGGGTKVEIK

SEQ ID NO: 7043 - protein, 106 aa, Artificial Sequence
  Description of Artificial Sequence: Synthetic polypeptide
DIQLTQSPSFLSASVGDRVTVTCRASQGITTYLAWYHQKPGEAPKLLIYGASSLQGGVPSRFSGSGSGTEFTLTISSLQPEDFATYYCQQLYSYPWTFGQGTKVEV

SEQ ID NO: 7044 - protein, 115 aa, Artificial Sequence
  Description of Artificial Sequence: Synthetic polypeptide
DIVMTQSPDSLAVSLGERATINCKSSQSVFVGPNNKNYLAWYQKKPGQPPKLLIYWSSAREAGVPDRFSGSGSGTDFTLTISSVQAEDVAVYYCQQCYGSPPMHTFGQGTRLEIR

SEQ ID NO: 7045 - protein, 107 aa, Artificial Sequence
  Description of Artificial Sequence: Synthetic polypeptide
EIVLTQSPGTLSLSPGERATLSCGASQSVGFNYLAWYQQKPGQAPRLLIYGASNRATDIPDRFSGSGSGTDFTLTISRLEPEDFAVYYCQQYGNIPRTFGQGTKVEI

SEQ ID NO: 7046 - protein, 112 aa, Artificial Sequence
  Description of Artificial Sequence: Synthetic polypeptide
DIVMTQSPDSLAVSLGERATISCKSSQSILSSSNNKNYLTWYQQKPGQPPKLLIYWASIRESGVPGRFSGSGSETDFTLTISSLQAEDVAVYYCQQYFTTPLTFGGGTKVEI

SEQ ID NO: 7047 - protein, 113 aa, Artificial Sequence
  Description of Artificial Sequence: Synthetic polypeptide
DIVMTQSPDSLAVSLGERATINCKSSQSVFSNSKNKNFLVWYQQKPGQPPKLLISWASTREPGVPERFSGSGFGTDFTLTIDSLQAEDVAVYFCQQCHSHPLTFGGGTKVEIK

SEQ ID NO: 7048 - protein, 112 aa, Artificial Sequence
  Description of Artificial Sequence: Synthetic polypeptide
DVVMTQSPLSLPVTLGQPASISCRSGQSLVNTDGNTYLSWFQQRPGQSPRRLIYKVSNRDSGVPDRFSGSGSGTDFTLRISRVEAEDVGVYYCVQGSHWPVTFGQGTKVEIK

SEQ ID NO: 7049 - protein, 114 aa, Artificial Sequence
  Description of Artificial Sequence: Synthetic polypeptide
DIVMTQSPDSLAVPLGERATINCKSSQSVLFGSDNRNYLAWFQQKPGRPPRLLIYWASTRYSGVPDRFSGSGSGTDFTLTISNLQAEDVAVYYCQHYYYPLVFTFGQGTKLEIK

SEQ ID NO: 7050 - protein, 112 aa, Artificial Sequence
  Description of Artificial Sequence: Synthetic polypeptide
DIVMTQSPDSLAVSLGERATINCKSSQSVINRNNNKDQIAWYQLKPGQPPKLLIYWASTRESGVPDRFSGSGSGTDFTLTISSLQAEDVAVYYCQQFSNTFTFGPGTKVDIK

SEQ ID NO: 7051 - protein, 113 aa, Artificial Sequence
  Description of Artificial Sequence: Synthetic polypeptide
DIVMTQSPDSLAVSLGERATINCKSSQSVLYSSNNMNFLAWFQKKPGQPPKLLIYWASTRASGVPDRFSGSGSGTDFTLTINSLQADDVAVYFCQQYYTAPITFGQGTRLEIK

SEQ ID NO: 7052 - protein, 107 aa, Artificial Sequence
  Description of Artificial Sequence: Synthetic polypeptide
EIVLTQSPGTLSLSPGERATLSCRASQNINKNYVAWYQHKPGQGPRLLIHAASSRATGIPDRFSGSGSGTDFTLTISRLEPEDFAVYFCQHYTTSPWTFGQGTKVEI

SEQ ID NO: 7053 - protein, 112 aa, Artificial Sequence
  Description of Artificial Sequence: Synthetic polypeptide
DVVMTQSPVSLSVTLGQPASISCRSSQSLVYSGGNTLLNWFQQRPGQSPRRLIYEVSNRDSGVPDRFSGSASGTEFTLKISRVEAEDIGVYYCMQGRHWPYTFGQGTKLEMI

SEQ ID NO: 7054 - protein, 113 aa, Artificial Sequence
  Description of Artificial Sequence: Synthetic polypeptide
DIVMTQSPDSLTVSLGERATIKCTSSQSVLYTPTNRLYLAWYQQKPGQPPKLLFLWASARQSGVPDRFSASGSETDFTLTISGLQAEDGAVYYCQQYYSLPRTFGQGTKVEIR

SEQ ID NO: 7055 - protein, 106 aa, Artificial Sequence
  Description of Artificial Sequence: Synthetic polypeptide
DIQLTQSPSFLSTSVGDRVTITCRASQGISNYLAWYQQKPGTAPKLLIYSASTLQSGVPSRFSGSGSGTEFTLTISSLQPEDFATYYCQHLKTSLVTFGQGTRLEM

SEQ ID NO: 7056 - protein, 109 aa, Artificial Sequence
  Description of Artificial Sequence: Synthetic polypeptide
DIQMTQSPSSLSASVGDRVTITCRASQSIGKYLNWYQQKPGKAPKLLIYAASNLQSGVPSRFGGSGSGTDFTLTISSLQPEDCATYYCQQSFTAPQKYTFGQGTKLEIK

SEQ ID NO: 7057 - protein, 107 aa, Artificial Sequence; identical to SEQ ID NO: 7045
  Description of Artificial Sequence: Synthetic polypeptide

SEQ ID NO: 7058 - protein, 111 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTLPFTFGPGTKVDIK

SEQ ID NO: 7059 - protein, 113 aa, Artificial Sequence
  Description of Artificial Sequence: Synthetic polypeptide
DIVMTQSPLSLPVTPGEPASISCRSSQSLLFSNEYNFLDWFLQKPGQSPQLLIYLGSNRASGVPDRFSGSGSGTDFTLKISRVEAEDVGVYYCMQALQIPRTFGQGTKVEIKR

SEQ ID NO: 7060 - protein, 108 aa, Artificial Sequence
  Description of Artificial Sequence: Synthetic polypeptide
DIQMTQSPSSLSASVGDRVTITCRASQGIRNVLVWYQQKPGKAPKRLIYAASSLQSGVPSRFSGSGSGTEFTLTISSLQPEDFATYYCLQHNSYPWTFGQGTKVEIKR

SEQ ID NO: 7061 - protein, 114 aa, Artificial Sequence
  Description of Artificial Sequence: Synthetic polypeptide
DIVMTQSPDSLAVSLGERATINCKSSQNILYNSNNNNYLAWFQQKPRQPPKLLIYWASTRESGVPDRFSGSGSGTDFTLTINSLQAEDVAVYYCQQYYSAPLTFGGGTKVEIKR

SEQ ID NO: 7062 - protein, 109 aa, Artificial Sequence
  Description of Artificial Sequence: Synthetic polypeptide
EIVLTQSPGTLSLSPGERATLSCRTSQSVSSIYLAWYQQKPGQAPRLLIYGASNRATGIPDRFSGSGFGTDFTLTISRLEPEDFAVYYCQQYGRSPLTFGGGTKVEIKR

SEQ ID NO: 7063 - protein, 107 aa, Artificial Sequence
  Description of Artificial Sequence: Synthetic polypeptide
ERVMTQSPATLSVSPGERATLSCRASQSVSSNLAWYQQKPGQAPRLIIYGASTRATGIPARFSGSGSGTEFTLTISSLQSEDFAVYYCQQYYHWLTFGGGTKVEIKR

SEQ ID NO: 7064 - protein, 108 aa, Artificial Sequence
  Description of Artificial Sequence: Synthetic polypeptide
DIQMTQSPSSLSASVGDRVTITCRASQGIRNDLGWYQQKPGKAPKRLIYAASSLQSGVPSRFSGSGSGTEFTLTISSLQPEDFATYYCLQYNSYPPTFGQGTKVEIKR

SEQ ID NO: 7065 - protein, 108 aa, Artificial Sequence
  Description of Artificial Sequence: Synthetic polypeptide
EIVMMQSPGPLSVSPGERAILSCRASQNVNINLAWYQQKPGQAPRLLIYGASTRATGIPARFSGSGSGTEFTFTISSLQSEDFAVYYCQQYKNWPLTFGGGTKVEIKR

SEQ ID NO: 7066 - protein, 113 aa, Artificial Sequence
  Description of Artificial Sequence: Synthetic polypeptide
DIVMTQSPDSLAVSLGERATINCKSSQNILYSSNNKNYLAWYQQKPGQPPKLLIYWASTRESGVPDRFSGSGSGTDFTLTISSLQAEDVAVYFCQQYYNIRTFGQGTKVEIKR

SEQ ID NO: 7067 - protein, 108 aa, Artificial Sequence
  Description of Artificial Sequence: Synthetic polypeptide
DIQMTQSPSSLSASVGDRVTITCRASQDIRNDLGWYQQKPGKAPKRLIYAASSLQSGVPSRFSGSGSGTEFTLTISSLQPEDFATYYCLQYKSYPWTFGQGTKVEIKR

SEQ ID NO: 7068 - protein, 107 aa, Artificial Sequence
  Description of Artificial Sequence: Synthetic polypeptide
DIQMTQSPSSVSASVGDRVTITCRASQGISSWLAWYQQKPGRAPKLLIYAASSLQSGVPSRFSGSGSGTGFTLTISSLQPEDVATYYCQQFWSTPYTFGQGTKLEIK

SEQ ID NO: 7069 - protein, 107 aa, Artificial Sequence
  Description of Artificial Sequence: Synthetic polypeptide
DIQMTQSPSSLSASVGDRVTITCRASQSISRWVAWYQQRPGKAPNLLIYDASSLKSGVPSRFSGSGSGTEFTLTISSLQPEDIATYYCQQFWSTPYTFGQGTKLEIK

SEQ ID NO: 7070 - protein, 107 aa, Artificial Sequence
  Description of Artificial Sequence: Synthetic polypeptide
DIQMTQSPSFLSASVGDRVTITCRASQGISTYLAWYQQKRGKAPKLLISAASSLQSGVPSRFSGSVSGTDFTLTISSLQSEDFAVYYCQQFWSTPYTFGQGTKLEIK

SEQ ID NO: 7071 - protein, 107 aa, Artificial Sequence
  Description of Artificial Sequence: Synthetic polypeptide
DIQLTQSPSFLSASVGDRVTITCRASQGISTYLAWYQQKPGKAPKLLIYDASALQSGVPSRFSGSGSGTEFTLTISSLQPEDVATYYCQQFWSTPYTFGQGTKLEIK

SEQ ID NO: 7072 - protein, 107 aa, Artificial Sequence
  Description of Artificial Sequence: Synthetic polypeptide
AIQLTQSPSFLSASVGDRVTITCRASQGISTYLAWYQQKPGKAPKLLIYAASSLQSGVPSRFSGSGSGTDFTLTISSLQPEDVATYYCQQFWSTPYTFGQGTKLEIK

SEQ ID NO: 7073 - protein, 107 aa, Artificial Sequence
  Description of Artificial Sequence: Synthetic polypeptide
DIQMTQSPSSLSASVGDRVTITCRASQSISRWVAWYQQRPGKAPNLLIYDASSLKSGVPSRFSGSGSGTEFTLTISSLQPEDIATYYCQQFWGTPYTFGQGTKLEIK

SEQ ID NO: 7074 - protein, 107 aa, Artificial Sequence
  Description of Artificial Sequence: Synthetic polypeptide
EIVMTQSPATLSVSPGERATLSCRASQSVSSNLAWYQQKPGQAPRLLIYGASTRATGIPARFSGSGSGTEFTLTISSLQSEDFAVYYCQQFWSTPYTFGQGTKLEIK

SEQ ID NO: 7075 - protein, 124 aa, Artificial Sequence; identical to SEQ ID NO: 7005
  Description of Artificial Sequence: Synthetic polypeptide

SEQ ID NO: 7076 - protein, 107 aa, Artificial Sequence
  Description of Artificial Sequence: Synthetic polypeptide
EIVMTQSPATLSVSPGERATLSCRASQSVSSNLAWYQQKPGQAPRLLFYAASTRATGIPARFSGSGSGTEFTLTISSLQSEDFAVYYCQQFWSTPYTFGQGTKLEIK

SEQ ID NO: 7077 - protein, 107 aa, Artificial Sequence
  Description of Artificial Sequence: Synthetic polypeptide
DIQLTQSPSTLSASVGDSVTITCRASEGVDRWLAWYQQKPGRAPKLLIYDASTLQSGVPSRFSGSGSGTEFSLTISSLQPDDVATYYCQHFWSTPYTFGQGTKLEIK

SEQ ID NO: 7078 - protein, 104 aa, Artificial Sequence
  Description of Artificial Sequence: Synthetic polypeptide
QSALTQPASVSGSPGQSITISCTGTSSDYVSWYQQHPGKAPKLIIYDVTNRPSGVPDRFSGSKSGNTASLTISGLQAEDEADYYCQHFWSTPYTFGGGTKLTVL

SEQ ID NO: 7079 - protein, 106 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCQHFWSTPYTFGGGTKLTVL

SEQ ID NO: 7080 - protein, 109 aa, Artificial Sequence
  Description of Artificial Sequence: Synthetic polypeptide
QSVLTQPPSASGSPGQSVTISCTGTSSDVGAYNYVSWYQQYPGKVPKLIIYEVTKRPSGVPDRFSGSKSGNTASLTVSGLRAEDEADYYCQHFWSTPYTFGGGTKLTVL

SEQ ID NO: 7081 - protein, 106 aa, Artificial Sequence
  Description of Artificial Sequence: Synthetic polypeptide
SSELTQDPAVSVALGQTVTITCQGDSLRSLYASWYQQKPGQAPVLVLYSKNSRPSGIPDRFSGSSSGNTASLTITGARAEDEADYYCQHFWSTPYTFGGGTKLTVL

SEQ ID NO: 7082 - protein, 107 aa, Artificial Sequence; identical to SEQ ID NO: 7010
  Description of Artificial Sequence: Synthetic polypeptide

SEQ ID NO: 7083 - protein, 108 aa, Artificial Sequence
  Description of Artificial Sequence: Synthetic polypeptide
EIVLTQSPGTLSLSPGERATLSCRASQTINRNYLAWYQQRPGQPPRLLIYAASTRATAIPDRFSGSGSGTAFTLTISRLEPEDSAVYYCQQYGSPPRTFGQGTKVEIK

SEQ ID NO: 7084 - protein, 107 aa, Artificial Sequence
  Description of Artificial Sequence: Synthetic polypeptide
DIQMTQSPSTVSASIGDRVTITCRASQNINIWLAWYHQKPGKAPKIVISEASVLEGGVPSRFSGSGYGTEFTLTISGLQPDDVGTYFCQQYDRYSPVFGGGTKVEVK

SEQ ID NO: 7085 - protein, 127 aa, Artificial Sequence; identical to SEQ ID NO: 7022
  Description of Artificial Sequence: Synthetic polypeptide

SEQ ID NO: 7086 - protein, 107 aa, Artificial Sequence; identical to SEQ ID NO: 7073
  Description of Artificial Sequence: Synthetic polypeptide

SEQ ID NO: 7087 - protein, 107 aa, Artificial Sequence; identical to SEQ ID NO: 7004
  Description of Artificial Sequence: Synthetic polypeptide

SEQ ID NO: 7088 - protein, 107 aa, Artificial Sequence; identical to SEQ ID NO: 7077
  Description of Artificial Sequence: Synthetic polypeptide

SEQ ID NO: 7089 - protein, 108 aa, Artificial Sequence
  Description of Artificial Sequence: Synthetic polypeptide
DIVMTQSHIFMSTSVGDRVSITCKASQDVGSAVAWYQQKPGQSPKVLIYWTSTRHTGVPDRFAGSGSGTEFTLTISNVQSEDLADYFCQQYSSYPLTFGAGTKLELKR

SEQ ID NO: 7090 - protein, 108 aa, Artificial Sequence
  Description of Artificial Sequence: Synthetic polypeptide
DIVMTQSPSFLSASVGDRVTITCKASQDVGSAVAWYQQKPGKAPKVLIYWTSTRHTGVPDRFAGSGSGTEFTLTISSLQPEDFADYFCQQYSSYPLTFGQGTKLELKR

SEQ ID NO: 7091 - protein, 128 aa, Artificial Sequence
  Description of Artificial Sequence: Synthetic polypeptide
MKSHTQVFVSILLWLYGADGNIVMTQSPKSMSMSVGERVTLTCKASENVVTYVSWYQQKPEQSPKLLIYGASNRYTGVPDRFTGSGSATDFTLTISSVQAEDLADYHCGQGYSYPYTFGGGTKLEIKR

SEQ ID NO: 7092 - protein, 108 aa, Artificial Sequence
  Description of Artificial Sequence: Synthetic polypeptide
NIVMTQSPSSLSASVGDRVTITCKASENVVTYVSWYQQKPGKAPKLLIYGASNRYTGVPDRFTGSGSATDFTLTISSLQPEDFADYHCGQGYSYPYTFGQGTKLEIKR

SEQ ID NO: 7093 - protein, 112 aa, Artificial Sequence
  Description of Artificial Sequence: Synthetic polypeptide
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPLTFGGGTKVEIK

SEQ ID NO: 7094 - protein, 107 aa, Artificial Sequence; identical to SEQ ID NO: 7071
  Description of Artificial Sequence: Synthetic polypeptide

SEQ ID NO: 7095 - protein, 107 aa, Artificial Sequence; identical to SEQ ID NO: 7068
  Description of Artificial Sequence: Synthetic polypeptide

SEQ ID NO: 7096 - protein, 107 aa, Artificial Sequence; identical to SEQ ID NO: 7069
  Description of Artificial Sequence: Synthetic polypeptide

SEQ ID NO: 7097 - protein, 106 aa, Artificial Sequence
  Description of Artificial Sequence: Synthetic polypeptide
AIQLTQSPSFLSASVGDRVTITCRASQGISTYLAWYQQKPGKPKLLIYAASSLQSGVPSRFSGSGSGTDFTLTISSLQPEDVATYYCQQFWSTPYTFGQGTKLEIK

SEQ ID NO: 7098 - protein, 107 aa, Artificial Sequence; identical to SEQ ID NO: 7070
  Description of Artificial Sequence: Synthetic polypeptide

SEQ ID NO: 7099 - protein, 126 aa, Artificial Sequence
  Description of Artificial Sequence: Synthetic polypeptide
EVQLVESGGGLVQPGGSLRLSCAASGSTLDYYAIGWFRQAPGKEREGVSCTSNSGSTYYGGSVKGRFTASRDNAKNTVYLQMNSLRPEDTAVYYCVATIGCATLGGTLDVQRYYYRGQGTQVTVSS

SEQ ID NO: 7100 - protein, 120 aa, Artificial Sequence
  Description of Artificial Sequence: Synthetic polypeptide
EVQLVESGGGLVQAGGSLRLSCTASGRTLSSYTMGWFRQAPGTEREFVAAMTRSGFNTYYADSVKGRFTISRDSTENTMALQMSSLKPEDTAVYYCTAGRGLTSYRADYWGQGTLVTVSS

SEQ ID NO: 7101 - protein, 111 aa, Artificial Sequence
  Description of Artificial Sequence: Synthetic polypeptide
EVQLVESGGGLVQPGGSLRLSCAASGSTRSVNPMAWFRQAPGRQREWVATISRSGYATYADSVKGRFTISGDNAKSSVYLQMNSLKPEDTAVYYCVTGTYWGQGTLVTVSS

SEQ ID NO: 7102 - protein, 121 aa, Artificial Sequence
  Description of Artificial Sequence: Synthetic polypeptide
EVQLVESGGGLVQPGDSLRLSCAASGRILSINNMVWYRQAPGKQRELVAHITSSGSTGYADSVKGRFTISRDNAKNTFYLQMTNLNPEDTAVYYCNCWVSSDSNAPLKNYWGQGTQVTVSS

SEQ ID NO: 7103 - protein, 121 aa, Artificial Sequence
  Description of Artificial Sequence: Synthetic polypeptide
EVQLVESGGGLVQPGGSLRLSCAASGSIFSINNMGWYRQAPGKQRELVTVVTSNLITTYADSVKGRFTISRDNAKNTVYLQMNSLKPEDTAVYYCNAWARSVGSVPYSQFWGQGTLVTVSS

SEQ ID NO: 7104 - protein, 114 aa, Artificial Sequence
  Description of Artificial Sequence: Synthetic polypeptide
EVQLVESGGGLVQPGGSLRLSCAASGSFGDNYELYAMTWFRQAPGERRDFVASVTGDGSTSYADSVKDRFTISRDNAKKLMYLQMNSLKPEDTAVYYCRLLNYWGQGTLVTVSS

SEQ ID NO: 7105 - protein, 121 aa, Artificial Sequence
  Description of Artificial Sequence: Synthetic polypeptide
EVQLVESGGGLVQPGGSLRLSCAASGSIFSINTMGWYRQAPGKQRELVSTITSNLVPHYADSVQGRFTISRDNARNTVYLQMNSLKPQDTAHYYCNAWARSSGATPYTNYWGQGTLVTVSS

SEQ ID NO: 7106 - protein, 121 aa, Artificial Sequence
  Description of Artificial Sequence: Synthetic polypeptide
EVQLVESGGGLVQPGGSLRLSCAASGSIFSINTMGWYRQAPGKQRDLVASITMNQVPNYADSVQGRFTISRDNVRNTVHLQMNAVKPEDTADYFCNAWVRSSGASPYTNYWGQGTQVTVSS

SEQ ID NO: 7107 - protein, 122 aa, Artificial Sequence
  Description of Artificial Sequence: Synthetic polypeptide
EVQLVESGGGLVQAGGSLRLSCAAASRLTFNHYNMGWFRQAPGKEREVAEVTWSGDKIYYVDSVKGRFTISRDNTPNPVYLYLQMNSLKPEDTAVYYCATAPRGLPYANGYWGQGTQVTVSS

SEQ ID NO: 7108 - protein, 121 aa, Artificial Sequence
  Description of Artificial Sequence: Synthetic polypeptide
EVQLVESGGGLVQPGGSLRLSCAASGRIFSINTMGWYRQAPGKQRELVAGVTINAITNYADSVKGRFTISRDNAKNTVWLQMNSLKPEDTAVYYCHAWARSSGSAPYWQNWGQGTQVTVSS

SEQ ID NO: 7109 - protein, 120 aa, Artificial Sequence
  Description of Artificial Sequence: Synthetic polypeptide
EVQLVESGGGLVQAGGSLRLSCAASGRTFSSYIMGWFRQAPGKAREFVADITWGQRPYYADSVKGRFTISRDNAKNTVYLEMNSLKPEDTAVYYCAADLGVVIREEHAYWGQGTLVTVSS

SEQ ID NO: 7110 - protein, 117 aa, Artificial Sequence
  Description of Artificial Sequence: Synthetic polypeptide
EVQLVESGGGLVQAGGSLRLSCAASGNTFSTNPMYWYRQAEGKQRELVASISSRGITNYADSVRGRFSISRDNTKDTVYLQMNSLKPEDTAVYYCRLASLSSGTVYWGKGTLVTVSS

SEQ ID NO: 7111 - protein, 127 aa, Artificial Sequence
  Description of Artificial Sequence: Synthetic polypeptide
EVQLVESGGGLVQAGGLSRLSCAASGFTFDDYVIGWFRQAPGKEREGVSCISRLDGRTYYTDSVKGRFTISSDNAKNTVYLQMNSLKPEDTAVYYCALEPRYTGDYYPVHPELYDYWGQGTQVTVSS

SEQ ID NO: 7112 - protein, 126 aa, Artificial Sequence
  Description of Artificial Sequence: Synthetic polypeptide
EVQLVESGGGLVQAGGSLRLSCVISASTVRNYDMGWFRQAPGKEREFVAAIDWSGGSTRYADSVKGRFTVSRDNAKNTVYLQMNSLKPEDTAVYYCVAAGFYNNYLRTAPNDWNYWGQGTLVTVSS

SEQ ID NO: 7113 - protein, 126 aa, Artificial Sequence
  Description of Artificial Sequence: Synthetic polypeptide
EVQLVESGGGLVQAGGSLRLSCVISEDGVRNYDMGWFRQAPGKEREFVATINWSGGSTNYADSVKGRFTVSRDNAKNTMYLQMDSLKPEDTAVYYCVAAGFYNNYLRTAPNDWNDWGQGTQVTVSS

SEQ ID NO: 7114 - protein, 123 aa, Artificial Sequence
  Description of Artificial Sequence: Synthetic polypeptide
EVQLVESGGGLVQPGGSLRLSCAASGFSLGVFAIGWFRQAPGKEREGVSCIDSSDGRTTYADSVKGRFTISRDNAKNTVYLQMNSLKPEDTAVYYCATDIETDVCSGAGWGFWGQGTQVTVSS

SEQ ID NO: 7115 - protein, 121 aa, Artificial Sequence
  Description of Artificial Sequence: Synthetic polypeptide
EVQLVESGGGLVQPGGSLRLSCAASGRIFSINNMGWYHQAPGKQRELVATITMNGITTYADSVKGRFTISRDNAKNTVYLQMNSLKPEDTAVYYCSCWVRSSGGDPYRDYWGQGTQVTVSS

SEQ ID NO: 7116 - protein, 125 aa, Artificial Sequence
  Description of Artificial Sequence: Synthetic polypeptide
EVQLVESGGGLVQAGGSLRLSCTASGHTFSSYTMGWFRQAPGKEREFVAAMTRSGFNTHYSDSVKGRFTISRDNTSRDNTKITMALQMNSLKPEDTAVYYCTTGRGLTSYVANFWGQGTQVTVSS

SEQ ID NO: 7117 - protein, 126 aa, Artificial Sequence
  Description of Artificial Sequence: Synthetic polypeptide
EVQLVESGGGLVQPGGSLRLSCAASGITLDSIAICWFRQAPGKEREGVSCSRGSDGSTYYADSVKGRFTISRVNAKNTVYLQMNSLKPEDTAVYYCAAAPSIFYSGGYFPSGMDYWGKGTQVTVSS

SEQ ID NO: 7118 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGGGSALEIVLTQSPSSLSASVGDRVTITCRASQSIRSHLNWYQQKPGKAPKLLIYGASNLQSGVPSRFSGSGSGTDFTLTISSLQPEDFATYYCQQSYSTPQTFGQGTKLEIK

SEQ ID NO: 7119 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGSGSAQSVVTQPASVSGSLGQSITISCTGTSSDAGSYNFVSWYQQHPGKAPKLIIYDVNNRPSGVSNRFSGSKSGNTASLTISGLQAEDEADYYCNSYGGSSTWLFGGGTKLTVL

SEQ ID NO: 7120 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGGGSALSYELMQPPSVSGTPGQRVTISCSGSSSNIGSNTVNWYQQLPGTAPKLLIYSNNQRPSGVPDRFSGSKSGTSASLAISGLQSEDEADYYCAAWDDSLNVVFGGGTKVTVL

SEQ ID NO: 7121 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGSGSAQTVVTQPASVSGSPGQSITISCTGTSSDIGGYNYVSWYRQHPGKAPKLMIYDVSNRPSGVSNRFSGSKSGNTASLTISGLQAEDEADYYCTSYTSDSTLVFGGGTKVTVL

SEQ ID NO: 7122 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGGGSAQSVVTQPPSVSAAPGQKVTISCTGTSSDVGSYNFVSWYQQHPGKAPKLMIYEGTKRPSGVSNRFSGSKSGNTASLTISGLQAEDEADYYCTSYTSDSTLVFGGGTKVTVL

SEQ ID NO: 7123 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGSGSAQSVLTQPASVSGSPGQSITISCTGTTSDVGAFGFVSWYQQKPGEVPKLMIYDVSDRPSGVSDRFSGSKSGSTASLTISGLQAEDEADYYCGSYTSTSTWVFGGGTKLTVL

SEQ ID NO: 7124 - protein, 246 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGGGSALSYELMQPASVSGSLGQSITISCTGTSSDVGSYNFVSWYQQHPGKAPKLMIYEGTKRPSGVPDRFSGSKSGNTASLTISGLQAEDEADYYCSSYARSYTYVFGTGTKVTVL

SEQ ID NO: 7125 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGGGSAQTVVTQPASVSGSPGQSITISCTGTSGDIGAYNFVSWYQQHPGKAPKLIIYDVNNRPSGVSNRFSGSKSGNTASLTISGLQAEDEADYYCSSYTSSNTYLFGTGTKVTVL

SEQ ID NO: 7126 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGSGSAQSVLTQPPSAFGTPGQSLTISCSGSNSNIGRNTVTWYQHLPGTAPKLLIYSSNQRPSGVPDRFSGSKSGTSASLAISGLQSEDEAHYYCAAWDDSLHGMIFGGGTKVTVL

SEQ ID NO: 7127 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGGGSAQSVLTQPPSAFGTPGQSLTISCSGSNSNIGRNTVTWYQHLPGTAPKLLIYSSNQRPSGVPDRFSGSKSGTSASLAISGLQSEDEAHYYCAAWDDSLHGMIFGGGTKVTVL

SEQ ID NO: 7128 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGSGSGGGGSAQSVLTQPPSAFGTPGQSLTISCSGSNSNIGRNTVTWYQHLPGTAPKLLIYSSNQRPSGVPDRFSGSKSGTSASLAISGLQSEDEAHYYCAAWDDSLHGMIFGGGTKVTVL

SEQ ID NO: 7129 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGSGSAQTVVTQPPSAFGTPGQSLTISCSGSSSNIGGNTVNWYQQLPGTAPRLLIYSNSQRPSGVPDRFSGSKSGTSASLAISGLQSEDEADYYCAAWDDSLNGVVFGGGTKLTVL

SEQ ID NO: 7130 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGGGSAQSVLTQPASVSGSPGQSITISCTGTSSDVGAYNYVSWFQQHPGKVPKLIIWEVINRPSGVSNRFSGSKSGNTASLTISGLQAEDEADYYCSSYTSSNTYVFGTGTKLTVL

SEQ ID NO: 7131 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGSGSAQSALTQPPSVSAAPGQKVTISCSGSSSNIGNNYVSWYLQLPGTAPKLLIYDNNGRPSGIPDRFSGSKSGTSATLGITGLQTGDEADYYCATWDSSLSAGVFGGGTKVTVL

SEQ ID NO: 7132 - protein, 244 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGSGSALSYELMQDPAVSVALGQTVRITCRGDSLSSFYTSWYQQKPGQAPLLVIYGKNNRPSGIPDRFSGSSSGNTASLTITGAQAEDEADYYCNSRDSSDNYVLFGGGTKLTVL

SEQ ID NO: 7133 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGDWDLLHALDIWGQGTLVTVSSGGGGSGGGGSGGGGSAQSVVTQPASVSGSPGQSVTISCTGTSSDVGSYKGVSWYQQPPGTAPKLLIYNDNQRPSGIPGRFSGSNSGNTAILTISGTQAMDEADYYCQAWDSSNHVVFGGGTKLTVL

SEQ ID NO: 7134 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDIWGQGTMVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7135 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDIWGQGTMVTVSSGGGGSGGGGSGGSGSAQTVVTQPASVSGSPGQSITISCTGTSSDIGGYNYVSWYRQHPGKAPKLMIYDVSNRPSGVSNRFSGSKSGNTASLTISGLQAEDEADYYCTSYTSDSTLVFGGGTKVTVL

SEQ ID NO: 7136 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDIWGQGTTVTVSSGGGGSGGGGSGGSGSAQTVVTQPASVSGSPGQSITISCTGTSSDIGGYNYVSWYRQHPGKAPKLMIYDVSNRPSGVSNRFSGSKSGNTASLTISGLQAEDEADYYCTSYTSDSTLVFGGGTKVTVL

SEQ ID NO: 7137 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHAFDIWGQGTMVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7138 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALGIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7139 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHAPDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7140 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHAPDIWGQGTLVTVSSGGGGSGGGGSGGSGSAQTVVTQPASVSGSPGQSITISCTGTSSDIGGYNYVSWYRQHPGKAPKLMIYDVSNRPSGVSNRFSGSKSGNTASLTISGLQAEDEADYYCTSYTSDSTLVFGGGTKVTVL

SEQ ID NO: 7141 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDVWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7142 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDIWGQGTMVTVSSGGGGSGGGGSGGGGSAQSVVTQPPSVSAAPGQKVTISCTGTSSDVGSYNFVSWYQQHPGKAPKLMIYEGTKRPSGVSNRFSGSKSGNTASLTISGLQAEDEADYYCTSYTSDSTLVFGGGTKVTVL

SEQ ID NO: 7143 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDIWGQGTTVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7144 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDIWGQGTTVTVSSGGGGSGGGGSGGGGSAQSVVTQPPSVSAAPGQKVTISCTGTSSDVGSYNFVSWYQQHPGKAPKLMIYEGTKRPSGVSNRFSGSKSGNTASLTISGLQAEDEADYYCTSYTSDSTLVFGGGTKVTVL

SEQ ID NO: 7145 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHAFDIWGQGTMVTVSSGGGGSGGGGSGGSGSAQTVVTQPASVSGSPGQSITISCTGTSSDIGGYNYVSWYRQHPGKAPKLMIYDVSNRPSGVSNRFSGSKSGNTASLTISGLQAEDEADYYCTSYTSDSTLVFGGGTKVTVL

SEQ ID NO: 7146 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHAFDIWGQGTMVTVSSGGGGSGGGGSGGGGSAQSVVTQPPSVSAAPGQKVTISCTGTSSDVGSYNFVSWYQQHPGKAPKLMIYEGTKRPSGVSNRFSGSKSGNTASLTISGLQAEDEADYYCTSYTSDSTLVFGGGTKVTVL

SEQ ID NO: 7147 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHAPDIWGQGTLVTVSSGGGGSGGGGSGGGGSAQSVVTQPPSVSAAPGQKVTISCTGTSSDVGSYNFVSWYQQHPGKAPKLMIYEGTKRPSGVSNRFSGSKSGNTASLTISGLQAEDEADYYCTSYTSDSTLVFGGGTKVTVL

SEQ ID NO: 7148 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDMWGQGTLVTVSSGGGGSGGGGSGGSGSAQTVVTQPASVSGSPGQSITISCTGTSSDIGGYNYVSWYRQHPGKAPKLMIYDVSNRPSGVSNRFSGSKSGNTASLTISGLQAEDEADYYCTSYTSDSTLVFGGGTKVTVL

SEQ ID NO: 7149 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDMWGQGTLVTVSSGGGGSGGGGSGGGGSAQSVVTQPPSVSAAPGQKVTISCTGTSSDVGSYNFVSWYQQHPGKAPKLMIYEGTKRPSGVSNRFSGSKSGNTASLTISGLQAEDEADYYCTSYTSDSTLVFGGGTKVTVL

SEQ ID NO: 7150 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDMWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7151 - protein, 243 aa, Artificial Sequence; identical to SEQ ID NO: 7141
  Description of Artificial Sequence: Synthetic polypeptide

SEQ ID NO: 7152 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDVWGQGTLVTVSSGGGGSGGGGSGGSGSAQTVVTQPASVSGSPGQSITISCTGTSSDIGGYNYVSWYRQHPGKAPKLMIYDVSNRPSGVSNRFSGSKSGNTASLTISGLQAEDEADYYCTSYTSDSTLVFGGGTKVTVL

SEQ ID NO: 7153 - protein, 245 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHALDVWGQGTLVTVSSGGGGSGGGGSGGGGSAQSVVTQPPSVSAAPGQKVTISCTGTSSDVGSYNFVSWYQQHPGKAPKLMIYEGTKRPSGVSNRFSGSKSGNTASLTISGLQAEDEADYYCTSYTSDSTLVFGGGTKVTVL

SEQ ID NO: 7154 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHVLDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7155 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLFHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7156 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLPHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7157 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLRALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7158 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGNWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7159 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWNLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7160 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHTLDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7161 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWELLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7162 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWDLLHAFDMWGQGTMVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7163 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWALLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7164 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADRDLLHALDIWGQGTMVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7165 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCTRADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7166 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCVRADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7167 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKGRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7168 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHPSGYTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7169 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSNGYTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7170 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYTHSSGYTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7171 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYADYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7172 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSGGYTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7173 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKRRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7174 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYSPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7175 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPFLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7176 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSRYTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7177 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTGYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7178 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIRSSGYTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7179 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKNRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7180 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDHNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7181 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHFSGYTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7182 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNSSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7183 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLRSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7184 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGHTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7185 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYYHPSGYTDYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7186 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGFTSYNPSLKSRVTISGDTSKKQFSLHVSSVTAADTAVYFCARADWDLLHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7187 - protein, 735 aa, Artificial Sequence
  Description of Artificial Sequence: Synthetic polypeptide
GAGGTGCAGCTGTTGGAGTCGGGCCCAGGACTGGTGAAGCCTTCGGAGACCCTGTCCCTCACCTGCAATGTCGCTGGTGGCTCCATCAGTCCTTACTACTGGACCTGGATCCGGCAGCCCCCAGGGAAGGGCCTGGAGTTGATTGGTTATATCCACTCCAGTGGGTACACCGACTACAACCCCTCCCTCAAGAGTCGAGTCACCATATCAGGAGACACGTCCAAGAAGCAGTTCTCCCTGCACGTGAGCTCTGTGACCGCTGCGGACACGGCCGTGTACTTCTGTGCGAGAGGCGATTGGGACCTGCTTCATGCTCTTGATATCTGGGGCCAAGGGACCCTGGTCACCGTCTCGAGTGGAGGCGGCGGTTCAGGCGGAGGTGGCTCTGGCGGTAGCGGAAGTGCACAGTCTGTGCTGACTCAGCCTGCCTCCGTGTCCGGGTCACCTGGACAGTCGATCACCATATCCTGCACTGGCACCACCAGCGACGTTGGTGCTTTTGGCTTTGTCTCCTGGTACCAACAGAAGCCAGGCGAAGTCCCCAAACTCATGATTTATGATGTCAGTGATCGGCCCTCAGGGGTTTCTGATCGCTTCTCTGGCTCCAAGTCTGGCAGCACGGCCTCCCTGACCATCTCTGGGCTCCAGGCTGAGGACGAGGCTGATTATTACTGCGGCTCATATACAAGCACCAGCACTTGGGTGTTCGGCGGAGGGACCAAGCTGACCGTCCTA

SEQ ID NO: 7188 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARATDEADHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCSQSDTFPLTFGGGTKLEIK

SEQ ID NO: 7189 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARADWSGTRALDIWGQGTLVTVSSGGGGSGGGGSGGGGSALEIVLTQSPSSLSTSVGDRVTITCWASQSIRSHLNWYQQKPGKAPKLLIYGASNLQSGVPSRFSGSGSGTDFTLTISSLQPEDFATYYCGQSDAFPLTFGGGTKLEIK

SEQ ID NO: 7190 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARGLPEKPHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCLQGDLWPLTFGGGTKLEIK

SEQ ID NO: 7191 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARSLFTDDHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7192 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARASPGVVHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7193 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARAHIESHHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7194 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARATQAPAHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7195 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARSQHDLEHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSYSFPLTFGGGTKLEIK

SEQ ID NO: 7196 - protein, 243 aa, Artificial Sequence
  Description of Artificial Sequence: Synthetic polypeptide
EVQLLESGPGLVKPSETLSLTCNVAGGSISPYYWTWIRQPPGKGLELIGYIHSSGYTDYNPSLKSRVTISGDTSKKQFSLHVSSVTAADTAVYFCARAMPDMPHALDIWGQGTLVTVSSGGGGSGGGGSGGGGSALEIVLTQSPSSLSTSVGDRVTITCRASQSIRSHLNWYQQKPGKAPKLLIYGASNLQSGVPSRFSGSGSGTDFTLTISSLQPEDFATYYCQQSLEFPLTFGGGTKLEIK

SEQ ID NO: 7197 - protein, 125 aa, Artificial Sequence
  Description of Artificial Sequence: Synthetic polypeptide
QVQLQESGAEVKKPGESLKISCKGSGYSFTSYWIGWVRQMPGKGLEWMGIIYPGDSDTRYSPSFQGQVTISADKSISTAYLQWSSLKASDTAMYYCARLGLQDDYVWGSPNWFDPWGQGTLVTVS

SEQ ID NO: 7198 - protein, 126 aa, Artificial Sequence
  Description of Artificial Sequence: Synthetic polypeptide
QVQLQESGAEVKKPGSSVKVSCKASGGTFSRYALSWVRQAPGQGLEWMGGIIPIFGTTNYAQKFQGRVTIAADESTSTAYLELSSLRSEDTALYYCAKSYDYVWGSYRPNEYGLDIWGQGTMVTVS

SEQ ID NO: 7199 - protein, 122 aa, Artificial Sequence
  Description of Artificial Sequence: Synthetic polypeptide
QVQLQESGGGVVQPGRSLRLSCAASGFTFSSYAMHWVRQAPGKGLEWVSYISSSGSTIYYADSVKGRFTISRDNAKNSLYLQMNRLRAEDTAVYYCARDMAGTSYYYYYMDVWGKGTLVTVS

SEQ ID NO: 7200 - protein, 143 aa, Artificial Sequence
  Description of Artificial Sequence: Synthetic polypeptide
GGKLVQPGGSLRLSCAASGISFSASWMSWVRQAPGKGLEWVANIRGDGSDINYADFVKGRFIISRDNAKSSLYLQMDSLRVEDTAVYYCARDVRHGDFDYWGQGTLVTVSSASPTSPKVFPLSLDSTPQDGNVVVACLVQGFF

SEQ ID NO: 7201 - protein, 122 aa, Artificial Sequence
  Description of Artificial Sequence: Synthetic polypeptide
GGDLVKPGGSLRLSCAASGFTFSDYSMSWIRQAPGKGLEWLSSIDTTGSTIYYADSVKGRFTISRDNAKNSLNLQMNSLRAEDTAVYYCARGSAMWGSWGQGTLVTVSSASTKGPSVFPLAP

SEQ ID NO: 7202 - protein, 125 aa, Artificial Sequence
  Description of Artificial Sequence: Synthetic polypeptide
GGGLVQPGGSLRLSCAASGFTFSSHSMSWVRQAPGKGLEWVSAITGSGGDTDYPDSVKGRFTISRDNSNNTLYLQMSSLGAEETAVYYCARRSGSSYGPFDYWGQGTLVTVSSASTKGPSVFPLA

SEQ ID NO: 7203 - protein, 114 aa, Artificial Sequence
  Description of Artificial Sequence: Synthetic polypeptide
EIELTQSPATLSVSPGERATLSCRASQNIGNSLAWYQLKPGQAPRLVMYDPSTRATGIPARFSGSGSGTEFTLTINSLQSEDFAVYYCHQYADWPLGFGGGTKVEVERTVAAPS

SEQ ID NO: 7204 - protein, 136 aa, Artificial Sequence
  Description of Artificial Sequence: Synthetic polypeptide
AAELTQPPSVSAAPGQKVTISCSGNSSNIGNEYVSWYQQLPGTAPKLLIYDNNWRPSGIPDRFSGSKSGTSATLGITGLQTGDEADYYCGTWDSSLSAAVFGGGTKLTVLGQPKAAPSVTLFPPSSEELQANKATL

SEQ ID NO: 7205 - protein, 113 aa, Artificial Sequence
  Description of Artificial Sequence: Synthetic polypeptide
ELTQPPSVSAAPGQKVTISCSGNSSNIGNEYVSWYQQLPGTAPKLLIYDNNWRPSGIPDRFSGSKSGTSATLGITGLQTGDEADYYCGTWDSSLSAAVFGGGTRLTVLRQPKA

SEQ ID NO: 7206 - protein, 125 aa, Artificial Sequence
  Description of Artificial Sequence: Synthetic polypeptide
GGGLVQPGGSLRLSCAASGFTFSSHSMSWVRQAPGKGLEWVSAITGSGGDTDYPDSVKGRFTISRDNSRNTLYLQMSSLRAEETAVYYCARRSGSSYGPFDYWGQGTLVTVSSASTKGPSVFPLA

SEQ ID NO: 7207 - protein, 115 aa, Artificial Sequence
  Description of Artificial Sequence: Synthetic polypeptide
QVRLQQWGAGLLKPSETLSLTCAVFGGSFSGFSWSWIRQTPGKGLEWIGEIDYRGSTNYNPSLKSRVTILRDTSRSQFSLKLSSVTAADSAVFYCARGGPRFDYWGQGTLVTVSS

SEQ ID NO: 7208 - protein, 128 aa, Artificial Sequence
  Description of Artificial Sequence: Synthetic polypeptide
EVQLVESGGGLVQPGGSLRLSCAASGFTFNIFGMSWVRQAPGKGLEWVANIKQDGSEKYYVDSVKGRFTISRDNAKNSLYLQMNSLRAEDTAVYYCARDRFYYGSGSYYYYYNGMDVWGQGTTVTVSS

SEQ ID NO: 7209 - protein, 127 aa, Artificial Sequence
  Description of Artificial Sequence: Synthetic polypeptide
EVQLVESGGGLVQPGGSLRLSCAASGFTFSSFWMSWVRQAPGKGLEWVANIKQDGSEKFYVDSVKGRFTISRDNAKNSLYLQMNSLRAEDTAVYYCARDRITMVRPYYYFYNGLDVWGQGTTVTVSS

SEQ ID NO: 7210 - protein, 231 aa, Artificial Sequence
  Description of Artificial Sequence: Synthetic polypeptide
LINLVESGGGVVQPGRSLRLSCAASGFTFSRYGMHWVRQAPGKGLEWVAVVSSDGRTTYYADSVKGRFTISRDNSKNTLYLQMNSLRAEDTAVFYCAKEGGDNKFSFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCWARHHHHHH

SEQ ID NO: 7211 - protein, 130 aa, Artificial Sequence
  Description of Artificial Sequence: Synthetic polypeptide
EVQLVESGGGLVPPGGSLKLSCAASGFIFSSYGMSWVRQTPGKSLELVATINNNGDSTYYPDSVKGRFTISRDNAKNTLYLQMSSLKSEDTAMFYCARALISSATWFGYWGQGTLVTVSAAKTTAPSVYP

SEQ ID NO: 7212 - protein, 135 aa, Artificial Sequence
  Description of Artificial Sequence: Synthetic polypeptide
  MOD_RES (114)..(114): Any amino acid
EIQLQQSGPELMKPGASVKISCKASGYSFSSHYMHWVKQSHGKSLEWIGYIDPSNGETTYNQKFKGKATLTVDTSSSTANVHLSSLTSDDSAVYFCARGDYRYNGDWFFDVWGXGTTVTVSSAKTDSPIGLSGPI

SEQ ID NO: 7213 - protein, 253 aa, Artificial Sequence
  Description of Artificial Sequence: Synthetic polypeptide
MKKNIAFLLASMFVFSIATNAYAEIQLQQSGPELMKPGASVKISCKASGYSFSSHYMHWVKQSHGKSLEWIGYIDPSNGETTYNQKFKGKATLTVDTSSSTANVHLSSLTSDDSAVYFCARGDYRYNGDWFFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 7214 - protein, 125 aa, Artificial Sequence
  Description of Artificial Sequence: Synthetic polypeptide
DIQMTQSPSTLSASIGDRVTITCRASEGIYHWLAWYQQKPGKAPKLLIYEASRLQSGVPSRFSGSGSGTEFTLTISSLQPDDFATYYCLQDFTYPRTFGQGTKLEIKRAAAEQKLISEEDLNGAA

SEQ ID NO: 7215 - protein, 125 aa, Artificial Sequence
  Description of Artificial Sequence: Synthetic polypeptide
DIVMTQSPSSLSASVGDRVTITCRASQGISNYLAWFQQKPGKAPKSLIYAASSLQSGVPSKFSGSGSGTEFTLTISSLQPEDFATYYCQELISYPLTFGGGTKLEIKRAAAEQKLISEEDLNGAA

SEQ ID NO: 7216 - protein, 125 aa, Artificial Sequence
  Description of Artificial Sequence: Synthetic polypeptide
DIQMTQSPSSLSASVGDRVTITCRASQGISNYLAWFQQKPGKAPKSLIYAASSLQSGVPSKFSGSGSGTEFTLTISSLQPEDFATYYCQELISYPLTFGGGTKLEIKRAAAEQKLISEEDLNGAA

SEQ ID NO: 7217 - protein, 117 aa, Artificial Sequence
  Description of Artificial Sequence: Synthetic polypeptide
ELTQSPLSLSVTPGQPASISCKSGQSLLHSDGRTYLHWYLQKPGQPPQLLIYEVSNRFSGVPDRFSGSGSGTDFTLKISRVEAEDVGVYYCMQSLRLRTFGQGTKVEIKRTVAAPSV

SEQ ID NO: 7218 - protein, 114 aa, Artificial Sequence
  Description of Artificial Sequence: Synthetic polypeptide
ELTQSPDSLAVSLGERATINCKSSQNALVTSSNKNCLAWYQQKPGQPPKLLIFWASSRVSGVPDRFSGSGSGTDFTLTISSLQAEDVAVYYCQQCYGTKTFGQGTKLELKRTVA

SEQ ID NO: 7219 - protein, 114 aa, Artificial Sequence
  Description of Artificial Sequence: Synthetic polypeptide
ELTQSPLSSPVTLGQPASISCRSSQSLVHSNGNTYLSWLQQRPGQPPRVLIYEISKRLSGVPDRFSGSGAGTDFTLKISRVEAEDVGVYYCVQATQFPYTFGQGTKLEIKRTVA

SEQ ID NO: 7220 - protein, 129 aa, Artificial Sequence
  Description of Artificial Sequence: Synthetic polypeptide
ESGGGLVKPGGSLRLSCAASGFTFSKAWMNWVRQAPGKGLEWVGRIRGKAEGGTTDYPAPVKGRFTISRDDSESTLYLQMNGLKTEDTGVYYCTTGTGTTFHLDYWGRGALVTVSSASTKGPSVFPLAP

SEQ ID NO: 7221 - protein, 126 aa, Artificial Sequence
  Description of Artificial Sequence: Synthetic polypeptide
GGLVKPGESLRLSCAASGFTFNKAWMNWVRQAPGKGLEWVGRIRGVSEGGTTDYTTPVKGRFTISRDDSQDTVYLEMNSLKTEDTAVYYCATGTGTTFHLDYWGQGTLVTVSSASTKGPSVFPLAP

SEQ ID NO: 7222 - protein, 115 aa, Artificial Sequence
  Description of Artificial Sequence: Synthetic polypeptide
EIELTQSPATLSVSPGEGVTLSCRASQNVGNNLAWYQQKLGQPPRLLIYDASTRATGVPARFSGSGSGTEFTLTVSSLQSEDFTVYYCQQYSVWPLTFGGGAKVEIKGTVAAPSV

SEQ ID NO: 7223 - protein, 115 aa, Artificial Sequence; identical to SEQ ID NO: 7222
  Description of Artificial Sequence: Synthetic polypeptide

SEQ ID NO: 7224 - protein, 107 aa, Artificial Sequence
  Description of Artificial Sequence: Synthetic polypeptide
DIQMTQSPSSLSASVGDRVTITCRASQGISSWLAWYQQKPEKAPESLIYVASSLQSGVPSRFSGSGSGTDFTLTISSLQPEDFATYYCQQYNSYPPTFGQGTKVEIK

SEQ ID NO: 7225 - protein, 106 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEI

SEQ ID NO: 7226 - protein, 108 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQRSNWPPFTFGPGTKVDIK

SEQ ID NO: 7227 - protein, 123 aa, Artificial Sequence
  Description of Artificial Sequence: Synthetic polypeptide
DIVMTQSQKFMSTSVGDRVSVTCKASQNVGTNVAWYQQKPGQSPKALIYSSSYRYSGVPDRFTGSGSGTDFTLTISHVQSEDLADYFCQQYNIYPLTFGPGTKLELKRADAAPPTVSIFPPFE

SEQ ID NO: 7228 - protein, 131 aa, Artificial Sequence
  Description of Artificial Sequence: Synthetic polypeptide
DIVMTQTPLSLPVSLGDQASISCRSSQSLVHGIGNTYLHWYLQKPGQSPKLLIYKVSNRFSGVPDRFSGSGSGTDFTLRISRVEAEDLGLYFCSQSTHVPLTFGAGTKLELKRADAAPTVSIFPPSSEQLK

SEQ ID NO: 7229 - protein, 242 aa, Artificial Sequence
  Description of Artificial Sequence: Synthetic polypeptide
MKKNIAFLLASMFVFSIATNAYADIVMTQTPLSLPVSLGDQASISCRSSQSLVHGIGNTYLHWYLQKPGQSPKLLIYKVSNRFSGVPDRFSGSGSGTDFTLRISRVEAEDLGLYFCSQSTHVPLTFGAGTKLELKRAVAAPTVFIFPPSSEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7230 - protein, 120 aa, Artificial Sequence
  Description of Artificial Sequence: Synthetic polypeptide
MADVKLVESGGGLVKLGGSLKLSCSASGFTFSNYYMSWVRQTPEKRLELVADINGNGGSTYYPDTVKGRFTISRDNAKNTLYLQMSSLKSEDTALYYCVRRGGYYALDYWGQGTTVTVSS

SEQ ID NO: 7231 - protein, 118 aa, Artificial Sequence
  Description of Artificial Sequence: Synthetic polypeptide
  MOD_RES (58)..(60): Any amino acid
  MOD_RES (66)..(67): Any amino acid
EVQLQQSGTVLARPGASVKMSCKASGYTFTTYWMHWVKQRPGQGLEWIGAIYPGNSDXXXNQKFKXXAKLIAVTSTSTAYMELSSLTNEDSAVYYCTRGTGTEIWFAYWGQGTTVTVS

SEQ ID NO: 7232 - protein, 124 aa, Artificial Sequence
  Description of Artificial Sequence: Synthetic polypeptide
QVQLQESGPGLVKPSETLSLTCTVSGGSISGYYWSWIRQPPGKGLEWIGYIHYSRSTNSNPALKSRVTISSDTSKNQLSLRLSSVTAADTAVYYCARDTYYYDSGDYEDAFDIWGQGTMVTVSS

SEQ ID NO: 7233 - protein, 112 aa, Artificial Sequence
  Description of Artificial Sequence: Synthetic polypeptide
QLVLTQSPSASASLGASVKLTCTLSSGHSNYAIAWHQQQPGKGPRYLMKVNRDGSHIRGDGIPDRFSGSTSGAERYLTISSLQSEDEADYYCQTWGAGIRVFGGGTKLTVLG

SEQ ID NO: 7234 - protein, 117 aa, Artificial Sequence
  Description of Artificial Sequence: Synthetic polypeptide
EVQLQQSGAELVKPGASVKLSCTASGFNIKDTYIHWVKQRPEQGLEWIGRIDPANGNTHYDSQFQGKATITADTSSNTAYLQLSSLTSDDTAVYYCTRRVGYAMDYWGQGTSVTVSS

SEQ ID NO: 7235 - protein, 123 aa, Artificial Sequence
  Description of Artificial Sequence: Synthetic polypeptide
QVTLRESGPGILQPSQTLSLTCSFSGFSLNTSGMGVTWIRQPSGKGLEWLANIYWDDDKRYNPSLKSRLTISKANSRNQVFLKITSVDTADTATYYCTRPNYLGTVYWYFDVWGAGTMVTVSS

SEQ ID NO: 7236 - protein, 118 aa, Artificial Sequence
  Description of Artificial Sequence: Synthetic polypeptide
EVQLVESGGGLVKPGGSLKLSCAASGFAFSSYDMSWVRQTPEKRLEWVAYISSGGGITYYPDTVKGRFTISRDNAKNTLYVQMSSLKSEDTAIYYCTRHDRDSWFAYWGQGTLVTVSA

SEQ ID NO: 7237 - protein, 117 aa, Artificial Sequence
  Description of Artificial Sequence: Synthetic polypeptide
QVQLVQSGAEVVKPGASVKLSCKASGFNIKDTYIHWVKQRPGQGLEWIGRIDPANGNTHYDSQFQGKATITADTSTSTAYLQLSSLRSEDTAVYYCTRRVGYAMDYWGQGTTVTVSS

SEQ ID NO: 7238 - protein, 123 aa, Artificial Sequence
  Description of Artificial Sequence: Synthetic polypeptide
QVTLRESGPGILKPSQTLSLTCTFSGFSLNTSGMGVTWIRQPSGKGLEWLANIYWDDDKRYNPSLKSRLTISKANSRNQVFLKITSVDPVDTATYYCTRPNYLGTVYWYFDVWGQGTMVTVSS

SEQ ID NO: 7239 - protein, 118 aa, Artificial Sequence
  Description of Artificial Sequence: Synthetic polypeptide
EVQLVESGGGLVQPGGSLKLSCAASGFAFSSYDMSWVRQTPEKRLEWVAYISSGGGITYYPDTVKGRFTISRDNSKNTLYVQMSSLRAEDTAVYYCTRHDRDSWFAYWGQGTLVTVSS

SEQ ID NO: 7240 - protein, 123 aa, Artificial Sequence
  Description of Artificial Sequence: Synthetic polypeptide
EVMLVESGGGLVQPKGSLKLSCAASGFTFNNYAMNWVRQAPGKGLEWVARIRSKSNNYATFYADSVKDRFTISRDDSQSMLYLQMNNLKTEDTAMYYCVRRGASGIDYAMDYWGQGTSLTVSS

SEQ ID NO: 7241 - protein, 123 aa, Artificial Sequence
  Description of Artificial Sequence: Synthetic polypeptide
EVMLVESGEGLVQPKGSLKLSCAASGFTFNTYAMNWVRQAPGKGLEWVARIRSKSNNYATYYADSVKDRFTISRDDSQSMLYLQMNNLKTEDTAMYYCVRRGGKETDYAMDYWGQGTSVTVSS

SEQ ID NO: 7242 - protein, 118 aa, Artificial Sequence
  Description of Artificial Sequence: Synthetic polypeptide
EVMLVESGGGLVQPKGSLKLSCAASGFTFNNYAMNWVRQAPGKGLEWVARIRSKSNNYATFYADSVKDRFTISRDDSQSLYLQMNNLKTEDTAYCVRRGASGIDYAMWGQGTSLTVSS

SEQ ID NO: 7243 - protein, 124 aa, Artificial Sequence
  Description of Artificial Sequence: Synthetic polypeptide
QVQLQESGPGLVKPSETLSLTCTVSGGSISNYYWSWIRQSPGRGLEWIGYIHYSGSTNSNPSLKSRVTISVDTSKNQVSLKLGSVTAADTAIYYCARDTYYESSGHWFDGLDVWGQGTSVTVSS

SEQ ID NO: 7244 - protein, 124 aa, Artificial Sequence
  Description of Artificial Sequence: Synthetic polypeptide
QVQLVQSGAEMKRPGASVKVSCKASGYTFTNFGISWVRQAPGQGLEWIGWVSTYNGRTNYAQKFRGRVTMTTDTSTNTAYMELRSLGSDDTAVFYCARDYYETSGYAYDDFAIWGQGTLVTVSS

SEQ ID NO: 7245 - protein, 126 aa, Artificial Sequence
  Description of Artificial Sequence: Synthetic polypeptide
QVQLQESGPGLVKPSETLSLTCTVSGGSISGYYWSWIRQPPGKGLEWIGYIHYSRSTNSNPALKSRVTISSDTSKNQLSLRLSSVTAADTAVYYCARDTYYYDSGDYEDAFDIWGQGTMVTVSSAS

SEQ ID NO: 7246 - protein, 130 aa, Artificial Sequence
  Description of Artificial Sequence: Synthetic polypeptide
QVQLQESGPGLVKPSETLSLTCTVSGGSISNYYWSWIRQSPGRGLEWIGYIHYSGSTNSNPSLKSRVTISVDTSKNQVSLKLGSVTAADTAIYYCARDTYYESSGHWFDGLDVWGQGTSVTVSSASTKGP

SEQ ID NO: 7247 - protein, 124 aa, Artificial Sequence; identical to SEQ ID NO: 7232
  Description of Artificial Sequence: Synthetic polypeptide

SEQ ID NO: 7248 - protein, 123 aa, Artificial Sequence
  Description of Artificial Sequence: Synthetic polypeptide
QVTLRESGPGILKPSQTLSLTCTFSGFSLSTSGMGVTWIRQPSGKGLEWLANIYWDDDKRYNPSLKSRLTISKANSRNQVFLKITSVDPVDTATYYCTRPNYLGTVYWYFDVWGQGTMVTVSS

SEQ ID NO: 7249 - protein, 120 aa, Artificial Sequence
  Description of Artificial Sequence: Synthetic polypeptide
EVQLQQSGAEFVKRPGASVKLSCRVSGFNIKDYYINWVKQRTEQGLEWIGRIDPEDGETKYAPKFQGKATITADTSSNTANLHLSSLTSADTAVYYCASSGYAFAWFLYWGQGTLVTVSA

SEQ ID NO: 7250 - protein, 117 aa, Artificial Sequence
  Description of Artificial Sequence: Synthetic polypeptide
EVQLQQSGAELVKPGASVKLSCTASGFNIKDYFIHWVNQRTKQGLEWIGRIDPEDGETKYAPKFQGKATLTADTTSNTADLQLSSLTSEDTAVYYCVLYYSRSFDYWGQGTTLTVSS

SEQ ID NO: 7251 - protein, 119 aa, Artificial Sequence
  Description of Artificial Sequence: Synthetic polypeptide
EVQLQQSGAEFVKPGASVKLSCRVSGFNIKDYYINWVKQRTEQGLEWIGRIDPEDGETKYAPKFQGKATITADTSSNTANLHLSSLTSADTAVYYCASSGYAFAWFLYWGQGTLVTVSA

SEQ ID NO: 7252 - protein, 125 aa, Artificial Sequence
  Description of Artificial Sequence: Synthetic polypeptide
QVQLVQSGAEVKKPGSSVKVSCKTSGGTFNNVAINWVRQAPGQGLEWMGGIIPGLDTPNYAQKFQGRVTITADKSTTSTYLELSSLRSDDTAVYYCAREMEVSGRWRPTEAFEIWGQGTMVTVSS

SEQ ID NO: 7253 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREMEVSGRWRPTEAFEIWGQGTLVTVSS

SEQ ID NO: 7254 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREVEVSGRWRPTEAFEIWGQGTLVTVSS

SEQ ID NO: 7255 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCARELEVSGRWRPTEAFEIWGQGTLVTVSS

SEQ ID NO: 7256 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREREVSGRWRPTEAFEIWGQGTLVTVSS

SEQ ID NO: 7257 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREHEVSGRWRPTEAFEIWGQGTLVTVSS

SEQ ID NO: 7258 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREYEVSGRWRPTEAFEIWGQGTLVTVSS

SEQ ID NO: 7259 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREAEVSGRWRPTEAFEIWGQGTLVTVSS

SEQ ID NO: 7260 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCARECEVSGRWRPTEAFEIWGQGTLVTVSS

SEQ ID NO: 7261 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREDEVSGRWRPTEAFEIWGQGTLVTVSS

SEQ ID NO: 7262 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREEEVSGRWRPTEAFEIWGQGTLVTVSS

SEQ ID NO: 7263 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREFEVSGRWRPTEAFEIWGQGTLVTVSS

SEQ ID NO: 7264 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREGEVSGRWRPTEAFEIWGQGTLVTVSS

SEQ ID NO: 7265 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREIEVSGRWRPTEAFEIWGQGTLVTVSS

SEQ ID NO: 7266 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREKEVSGRWRPTEAFEIWGQGTLVTVSS

SEQ ID NO: 7267 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCARENEVSGRWRPTEAFEIWGQGTLVTVSS

SEQ ID NO: 7268 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREPEVSGRWRPTEAFEIWGQGTLVTVSS

SEQ ID NO: 7269 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREQEVSGRWRPTEAFEIWGQGTLVTVSS

SEQ ID NO: 7270 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCARESEVSGRWRPTEAFEIWGQGTLVTVSS

SEQ ID NO: 7271 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCARETEVSGRWRPTEAFEIWGQGTLVTVSS

SEQ ID NO: 7272 - protein, 125 aa, Artificial Sequence
  Description of Artificial Sequence: Synthetic polypeptide
QVQLVQSGAEVKKPGSSVKVSCKASGGTFNNVAINWVRQAPGQGLEWMGGIIPGLDTPNYAQKFQGRVTITADESTSTAYMELSSLRSEDTAVYYCAREWEVSGRWRPTEAFEIWGQGTLVTVSS

SEQ ID NO: 7273 - protein, 448 aa, Artificial Sequence
  Description of Artificial Sequence: Synthetic polypeptide
QVQLQESGPGLVKPSQTLSLTCTVSGGSISSGGYYWSWIRQPPGKGLEWIGYIYYSGSTYYNSSLKSRVTISVDTSKNQFSLKLSSVTAADTAVYYCAKTVMNSFFDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7274 - protein, 448 aa, Artificial Sequence
  Description of Artificial Sequence: Synthetic polypeptide
EVLESGGGLVQPGGSLRLSCSDSGFSFNNYWMTWVRQAPGKGLEWVANINRDGSDKYHVDSVEGRFTISRDNSKNSLYLQMNNLRADDAAVYFCARGGRTTSWYWRNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7275 - protein, 450 aa, Artificial Sequence
  Description of Artificial Sequence: Synthetic polypeptide
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7276 - protein, 451 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARRASIVGATHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7277 - protein, 451 aa, Artificial Sequence
  Description of Artificial Sequence: Synthetic polypeptide
EVQLVETGGVAVQPGRSLRLSCAASGFSFRDYGMHWVRQAAGKGLEWVAFIWPHGVNRFYADSMEGRFTISRDDSKNMLYLEMNNLRTEDTALYYCTRDQDYVPRKYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7278 - protein, 459 aa, Artificial Sequence
  Description of Artificial Sequence: Synthetic polypeptide
QVQLQESGPRLVKPSETLSLTCNVSDDSITSYGYYWGWIRQPPGEALEWIGNVFYSGMAYYNPSLKSRVTILIDTSKKQFSLRLNSVTAADTAIYYCARVPFLMFRVKIVQGTGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7279 - protein, 450 aa, Artificial Sequence
  Description of Artificial Sequence: Synthetic polypeptide
EVQLVESGGDLVQPGGSLRLSCVGSGFTFGRYAMSWVRQAPGKGLEWVASINNNGNPYYADSVKGRFTISADNSKSTVYLQMNSLRAEDTAMYYCAKDHYSSGWPAFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7280 - protein, 448 aa, Artificial Sequence
  Description of Artificial Sequence: Synthetic polypeptide
EVQLVESGAEVKKPGESLKISCKGSGYSFTSYWIGWVRQMPGKGLEWMGIIYPGDSDTRYSPSFQGQVTISADKSISTAYLQWSSLKASDTAMYYCARYSNSQGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7281 - protein, 452 aa, Artificial Sequence
  Description of Artificial Sequence: Synthetic polypeptide
QVQLVQSGAEVKKPGESLKISCKGSRYSSTSYWIGWVRQMPGEGLEWMGIIYPGDSDTRYSPSFQGQVTISADKSISTAYLQWSSLKASDSALYYCARGAVAGTVGNGFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7282 - protein, 451 aa, Artificial Sequence
  Description of Artificial Sequence: Synthetic polypeptide
EVQLVETGAEVKKPGESLKISCKGSGYSFTSYWIGWVRQMPGKGLEWVGIIYPGDSDTRYSPSFQGQVTISADKSISTAYLQWSSLKASDTAMYYCARRRGSTSSTDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7283 - protein, 451 aa, Artificial Sequence
  Description of Artificial Sequence: Synthetic polypeptide
QVQLVQSGAEVKKPGESLKISCKGSGYSFSTYWIGWVRQMPGKGLEWMGIIYPGDSDTRYSPSFQGQVTISADKSISTAHLQWSSLKASDTAMYYCARPGPRGYNHGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7284 - protein, 449 aa, Artificial Sequence
  Description of Artificial Sequence: Synthetic polypeptide
EVQLVESGAEVKEPGESLKISCKGSGYTFASYWVAWVRQMPGKGLEWMGIIYPGDSDTRYSPSFQGQVTVSADKSISTAYLQWSSLKASDTAMYYCARWWGSLHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7285 - protein, 453 aa, Artificial Sequence
  Description of Artificial Sequence: Synthetic polypeptide
EVQLVETGAEVQKPGESLKISCKGSGYTFTNYWIAWVRQKPGKGLEWMGIIYPGDSDTRYSPSFQGQVTISADKSISTAYLQWSSLKASDTAMYYCARRYCTTTSCSAGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7286 - protein, 450 aa, Artificial Sequence
  Description of Artificial Sequence: Synthetic polypeptide
EVQLVESGAEVKKPGESLKISCKGSGYSFTKYWIGWVRQKPGKGLEWMGIIYPGDSDTRYSPSFQGQVTISTDKSISTAYLQWSSLKASDTAMYYCARLGGGIAAAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7287 - protein, 450 aa, Artificial Sequence
  Description of Artificial Sequence: Synthetic polypeptide
EVQLVESGAEVKKPGESLKISCKGSGYTFTRYWIGWVRQMPGKGLEWMGIIYPGDSDTRYSPSFRGQVTISADKSISTAYLQWSSLKASDTAMYYCARRMGAASAYFDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7288 - protein, 453 aa, Artificial Sequence
  Description of Artificial Sequence: Synthetic polypeptide
EVQLVESGAEVKKPGESLKISCKGSGYSFTSYWIGWVRQMPGKGLEWMGIIYPGDSDTRYSPSFQGQVTISADKSISTAYLQWTSLKASDTAVYFCARLGEFRRTGNSYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7289 - protein, 445 aa, Artificial Sequence
  Description of Artificial Sequence: Synthetic polypeptide
EVQLVETGGDLVQPGGSLRLSCAASGFTFSSYAMGWVRQAPGKGLEWLSYIRNDGSVIYYADSVKGRFTISRDNAKNSLYLQMNSLRAEDTAVYYCARRGYLDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7290 - protein, 450 aa, Artificial Sequence
  Description of Artificial Sequence: Synthetic polypeptide
EVQLVESGGGLVQPGGSLRVSCAASGFTFSSYWMTWVRQAPGKGLEWVANIKKDGSEKYYVDSVKGRFSISRDNAKDSLYLQMSSLRAEDTAVYYCARGGSSSSFYWWLWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7291 - protein, 451 aa, Artificial Sequence; identical to SEQ ID NO: 7276
  Description of Artificial Sequence: Synthetic polypeptide

SEQ ID NO: 7292 - protein, 451 aa, Artificial Sequence
  Description of Artificial Sequence: Synthetic polypeptide
EVQLVETGGGLVQPGGSLRLSCSASGFTFSNYAMSWVRQAPGKGLEWVSGISGSGGRTYYADSVKGRFTISRDNSKNTLYLQMNSLGADDTAVYYCAKGVRAGVPYYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7293 - protein, 456 aa, Artificial Sequence
  Description of Artificial Sequence: Synthetic polypeptide
EVQLVQSGAEVKKPGESLKISCKASGYSFTSYWIGWVRQMPGKGLEWMGIIYPGDSDTRYSPSFQGQVIISADKSISTAYLQWSSLKASDTAMYYCARFKKSSAARGYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7294 - protein, 449 aa, Artificial Sequence
  Description of Artificial Sequence: Synthetic polypeptide
EVQLVQSGAEVKKPGESLKISCKGSGYTFSSYWIGWVRQMPGKGPEWMGIIYPGDSDTRYSPSFQGQVTISADRSISTAYLQWSSLKASDTAMYYCARLNTVMVGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7295 - protein, 447 aa, Artificial Sequence
  Description of Artificial Sequence: Synthetic polypeptide
QVQLQESGGGVVQPGRSLRLSCAASGFTFSSYGMHWVRQAPGKGLEWVAVISYDGSNKYYADSVKGRFTISRDNSKNTLYLQMNSLRAEDTAVYYCAKNGANAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7296 - protein, 451 aa, Artificial Sequence
  Description of Artificial Sequence: Synthetic polypeptide
EVQLVESGAEVKKPGESLKISCKGSGYSFTSYWIGWVRQLPGKGLEWMGIIYPGDSDTRYSPSFQGQVTISADKSTSTAYLQWSSLKASDTAMYYCARRRGSTSSTDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7297 - protein, 451 aa, Artificial Sequence
  Description of Artificial Sequence: Synthetic polypeptide
QVQLVQSGAEVKKSGESLKISCKGFGYSFTSQWIVWVRQMPGKGLEWMGIIYPGDSDTRYSPSFQGQVTISADRSISTAYLQWSSLKASDNAMYYCARALRGYSSSSFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7298 - protein, 448 aa, Artificial Sequence
  Description of Artificial Sequence: Synthetic polypeptide
EVQLVQSGAEVKKPGASVKVSCKASGYTFSNYYMHWVRQAPGQGLEWMGIINPSGGSTSYAQKFQGRFTVTRDTSTSTVYMELSSLRSEDTAVYYCATRRGQRYFQHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7299 - protein, 451 aa, Artificial Sequence
  Description of Artificial Sequence: Synthetic polypeptide
QVQLQQSGPGLVKPSQTLSLTCAISGDSVSSNRAAWNWIRQSPSRGLEWLGRTYYRSKWYNDYAVSVKSRISINPDALKNQFSLQLNSVTPEDTAVYYCARDTGWYRFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7300 - protein, 451 aa, Artificial Sequence
  Description of Artificial Sequence: Synthetic polypeptide
EVQLVQSGAEVKKPGESLKISCKGSGYSFTTYWIGWVRQMPGKGLEWMGMIYPGDSDTRYSPSFQGQVTISADKSISTAYLQWSSLKASDTAMYYCVRPLRSGSSYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7301 - protein, 453 aa, Artificial Sequence; identical to SEQ ID NO: 7285
  Description of Artificial Sequence: Synthetic polypeptide

SEQ ID NO: 7302 - protein, 451 aa, Artificial Sequence
  Description of Artificial Sequence: Synthetic polypeptide
QVQLVQSGAEVKKPGESLKISCKGSGYSFTNYWIAWVRQMPGKGLEWMGIIYPGDSDTRYSPSFQGQVTISADRSINTAYLQWSSLKASDTAMFYCARRLYGSGRPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7303 - protein, 452 aa, Artificial Sequence
  Description of Artificial Sequence: Synthetic polypeptide
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHTQNKNGMNTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7304 - protein, 446 aa, Artificial Sequence
  Description of Artificial Sequence: Synthetic polypeptide
QVQLQQWGAGLLKPSETLSLTCAVYGASFRGYYWSWIRQPPGKGLEWIGEINHSGSTNYNPSLKSRVTISVDTSKNQFSLKLSSVTAADTAVYYCARGRPDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7305 - protein, 453 aa, Artificial Sequence
  Description of Artificial Sequence: Synthetic polypeptide
QVQLVQSGAEVKKPGESLKISCKGSGYSFTNYWIGWVRQMPGKGLEWMGIIYPGDSDTRYSPSFRGQVTISADKSISTAYLQWSSLKASDTAMYYCARLGYSYGYRGPHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7306 - protein, 451 aa, Artificial Sequence
  Description of Artificial Sequence: Synthetic polypeptide
EVQLVESGGVAVQPGRSLRLSCAASGFSFRDYGMHWVRQAAGKGLEWVAFIWPHGVNRFYADSMEGRFTISRDDSKNMLYLEMNNLRTEDTALYYCTRDQDYVPRKYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7307 - protein, 453 aa, Artificial Sequence
  Description of Artificial Sequence: Synthetic polypeptide
QVQLVQSGAEVKKPGATVKISCKVSGYTFTDYYMHWVQQAPGKGLEWMGLVDPEDGETIYAEKFQGRVTITADTSTDTAYMELSSLRSDDTAVYYCARAEVMTTINNWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7308 - protein, 447 aa, Artificial Sequence
  Description of Artificial Sequence: Synthetic polypeptide
EVQLVESGGGLVKPGGSLGLSCAASGFFFSDYSMSWIRQAPGKGLEWLSNISGSGHSTKYAESMRGRITISRDNAKKSLSLQLNSLRAEDTAVYFCVRGGGYRMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7309 - protein, 448 aa, Artificial Sequence
  Description of Artificial Sequence: Synthetic polypeptide
QVQLVQSGPEVKKPGASVTVSCKASGYSFSSYGISWVRQAPGQGLEWMGRIIPVGGNTLYSQMFQGRVTMTSDTSTSTVYLELSSLRSEDTAVYFCARDGGRWQFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7310 - protein, 450 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSIGTAYLQWSSLKASDTAMYYCARLFRVRGGHFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7311 - protein, 452 aa, Artificial Sequence
  Description of Artificial Sequence: Synthetic polypeptide
EVQLVESGGGVVQPGRSLRLSCAASGFTFSSYGMHWVRQAPGKGLEWVAMIWSDGSNKYYADSVKGRFTISRDNSKNTLYLQMNSLRVEDTAVYYCASNYGSGSYWGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7312 - protein, 449 aa, Artificial Sequence
  Description of Artificial Sequence: Synthetic polypeptide
EVQLVESGAEVKKPGSSVKVSCKASGGTFSSYAISWVRQAPGQGLEWMGGIIPIFGTANYAQKFQGKVTITADESTSTAYMELSSLRSEDTAVYYCARLSPRYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7313 - protein, 450 aa, Artificial Sequence
  Description of Artificial Sequence: Synthetic polypeptide
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARGYAATDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7314 - protein, 453 aa, Artificial Sequence
  Description of Artificial Sequence: Synthetic polypeptide
EVQLVETGGGLVQPGGSLRLSCAASGFTFSSYSMNWVRQAPGKGLEWVSFISSSSSTIYYADSVKGRFTIARDNAKNSLYLQMNSLRDEDTAVYYCARPVGTGISLFHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7315 - protein, 450 aa, Artificial Sequence
  Description of Artificial Sequence: Synthetic polypeptide
EVQLVESGGGVVQPGRSLRLSCVASEFTFSNYGMHWVRQAPGKGLEWVAVIWYDGSNEDYADSVKGRFTISRDNSKNTVYLHMNSLRAEDTAVYFCTRGQYSSTWFLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7316 - protein, 446 aa, Artificial Sequence
  Description of Artificial Sequence: Synthetic polypeptide
QLQLQESGPGLVKPSETLSLTCAVSGYSITSGYYWGWVRQPPGKGLEWIGSIYHTGSTYYNPSLKSRVTISVDTSKNQFSLKLNSLTAADTAVYFCASQSPAFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7317 - protein, 445 aa, Artificial Sequence
  Description of Artificial Sequence: Synthetic polypeptide
EVQLVESGPGLVKPSETLSLTCTVSGGSISSYYWSWIRQPPGKGLEWIGYIYYTGTTNYNPSLNSRVTISADTSKNQFSLKLSSVTAADTAVYYCARGGQTAGVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7318 - protein, 445 aa, Artificial Sequence
  Description of Artificial Sequence: Synthetic polypeptide
EVQLVETGGGLVQPGGSLRLSCAASGLTFSSYAMSWVRQAPGKGLEWVSALSGSTTFYADSVKGRFTISRDNAKNTLYLQMNSLRAEDTAVYYCARGNYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7319 - protein, 451 aa, Artificial Sequence; identical to SEQ ID NO: 7283
  Description of Artificial Sequence: Synthetic polypeptide

SEQ ID NO: 7320 - protein, 457 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWGGVCSSTSCPNRDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7321 - protein, 446 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDSAVYYCARGGQRFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7322 - protein, 451 aa, Artificial Sequence
  Description of Artificial Sequence: Synthetic polypeptide
QVQLVQSGAEVKNPGESLKISCKGSGYTFTSYWIGWVRQMPGKGLEWMGSIYPGDSDTRYSPSFQGQVTISVDKSISTAYLQWSSLKASDTAMYYCARQYRAGSTTRFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7323 - protein, 216 aa, Artificial Sequence
  Description of Artificial Sequence: Synthetic polypeptide
SYVLTQPPSVSVAPGQTARITCGGNNIGSKSVHWYQQKPGQSPVLVMYQDRRRPSGIPERFSGSNSGHTATLTISGTQAMDEADYYCQAWDSSTGVFGTGTQLTVLSAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7324 - protein, 220 aa, Artificial Sequence
  Description of Artificial Sequence: Synthetic polypeptide
SYVLTQPPSASGTPGQRVTISCSGSSSNIGSNNVSWYQQLPGTAPKLLIYSNNQRPSGVPDRFSGSKSGTSASLAISGLQSEDEADYYCAAWDDSLNGWVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7325 - protein, 221 aa, Artificial Sequence
  Description of Artificial Sequence: Synthetic polypeptide
QSALTQPRSVPGSPGQSVTISCTGTSSDVGGYNYVSWYQQHPGKAPKLMIYDVSKRPSGVPDRFSGSKSGNTASLTVSGLQAEDEADYYCSSYAGSNNFVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7326 - protein, 213 aa, Artificial Sequence
  Description of Artificial Sequence: Synthetic polypeptide
DIQLTQSPSSVSASVGDRVTITCRASQGISNWLAWYQQKPGKAPELLIYAASSLQSGVPPRFSGSASGTDFTLTISSLQPEDFATYYCQQSKNFPYTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7327 - protein, 220 aa, Artificial Sequence
  Description of Artificial Sequence: Synthetic polypeptide
QSALTQPASVSGSPGQSITISCTGTNSDVGGYNYVSWYQQHPGKAPKLLIYDVTNRPSGVSNRFSASKSGNTASLTISGLQAEDEADYYCSSFTSSSTRVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7328 - protein, 220 aa, Artificial Sequence
  Description of Artificial Sequence: Synthetic polypeptide
QSALTQPASVSGSPGQSITISCTGTSSDVGGYNLVSWYQQHPGKAPKLMIYEGSKRPSGVSNRFFGSKSGDTASLTISGLQAEDEADYYCSSYTTSSTHVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7329 - protein, 220 aa, Artificial Sequence
  Description of Artificial Sequence: Synthetic polypeptide
QSALTQPRSVSGSPGQSVTISCTGTSSDVGGYNYVSWYQQHPGKAPKLMIYGGSERPSGVSNRFSGSKSGNTASLTISGVQAEDEADYYCSSYTSSGTLLFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7330 - protein, 213 aa, Artificial Sequence
  Description of Artificial Sequence: Synthetic polypeptide
DIQLTQSPSTLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7331 - protein, 218 aa, Artificial Sequence
  Description of Artificial Sequence: Synthetic polypeptide
QSVLTQPPSVSVAPGQTARITCGGNNIGSKYVHWYQQKPGQAPVLVVYDDSDRPSGIPERFSGSNSGNTATLTISRVEAGDEADFYCQVWDGSSDPVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7332 - protein, 213 aa, Artificial Sequence
  Description of Artificial Sequence: Synthetic polypeptide
DIQLTQSPSTLSASVGDRVTITCRASQSISSWLAWYQQKPGKAPKLLIYKASSLETGVPSRFSGSGSGTDFTLTISSLQPEDFATYYCQQANSFPLTFGGGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7333 - protein, 221 aa, Artificial Sequence
  Description of Artificial Sequence: Synthetic polypeptide
QSVLTQPPSVSGAPGQRVTISCTGSSSNIGTGYDVHWYQQLPGTAPKLLIYGNNNRPSGVPDRFSGSKSGTSASLAITGLQAEDEADYYCATWDDSLNGWVFGGGTKLTVPGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7334 - protein, 216 aa, Artificial Sequence
  Description of Artificial Sequence: Synthetic polypeptide
QSVLTQPPSVSVAPGQTARITCGGYNIGRKSVHWYQQKPGLAPVLVVYDNSDRPSGIPARFSGSNSGNTATLTISGTQAMDEADYYCQAWDRGTAVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7335 - protein, 220 aa, Artificial Sequence
  Description of Artificial Sequence: Synthetic polypeptide
SYVLTQPPSASGTPGQRVTISCSGSSSNIGKFYVYWYQQFPGAAPKLLIYSNNQRPSGVPDRFSGSKSGTSASLAISGLQSEDEADYYCAAWDGSLNGYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7336 - protein, 218 aa, Artificial Sequence
  Description of Artificial Sequence: Synthetic polypeptide
SSELTQDPAESVALGQTVKITCQGDSLRRYYASWYQQKPGQAPVLVIYGKNNRPSGIPDRFSGSRSGNTASLTITGAQAEDEAVYYCNSRDSSGNSVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7337 - protein, 222 aa, Artificial Sequence
  Description of Artificial Sequence: Synthetic polypeptide
QSALTQPRSVSGSPGQSVTISCTGTSSDVGGYNYVSWYQQHPGKAPKLMIYDVSNRPSGVSNRFSGSKSGNTASLTISGLQAEDEAEFHCSSYRSSGASPVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7338 - protein, 220 aa, Artificial Sequence
  Description of Artificial Sequence: Synthetic polypeptide
QSALTQPPSASGSPGQSVTISCTGTSSDVGGYNYVSWYQQLPGKAPKLLIYDVNNRPSGVSNRFSGSKSGNTASLTISGLQAEDEAEYYCGSSVGSRLRIFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7339 - protein, 218 aa, Artificial Sequence
  Description of Artificial Sequence: Synthetic polypeptide
DVVMTQSPLSLPVTPGEPASISCRSSQSLRHRNGNNYLDWYLQKPGQSPQLLIYLGSNRASGVPDRFSGSGSGTDFTLKISRVEAEDVGIYYCMQALQTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7340 - protein, 120 aa, Artificial Sequence
  Description of Artificial Sequence: Synthetic polypeptide
EVQLLESGGGLVQPGGSLRLSCAASGFTLSRFAMSWVRQAPGRGLEWVASINNGNNPYYARSVQYRFTVSRDVSQNTVSLQMNNLRAEDSATYFCAKDHPSSGWPTFDSWGPGTLVTVSS

SEQ ID NO: 7341 - protein, 120 aa, Artificial Sequence
  Description of Artificial Sequence: Synthetic polypeptide
EVQLVESGGGLVQPGGSLRLSCAASGFTLSRFAMSWVRQAPGRGLEWVASINNGNNPYYARSVQYRFTVSRDVSQNTVSLQMNNLRAEDSATYFCAKDHPSSGWPTFDSWGPGTLVTVSS

SEQ ID NO: 7342 - protein, 230 aa, Artificial Sequence
  Description of Artificial Sequence: Synthetic polypeptide
EVQLVESGGGLVQPGGSLRLSCAASGFTLSRFAMSWVRQAPGRGLEWVASINNGNNPYYARSVQYRFTVSRDVSQNTVSLQMNNLRAEDSATYFCAKDHPSSGWPTFDSWGPGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCP

SEQ ID NO: 7343 - protein, 230 aa, Artificial Sequence
  Description of Artificial Sequence: Synthetic polypeptide
EVQLVESGGGLVQPGGSLRLSCAASGFTLSRFAMSWVRQAPGRGLEWVASINSGNNPYYARSVQYRFTVSRDVSQNTVSLQMNNLRAEDSATYFCAKDHPSSGWPTFDSWGPGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCP

SEQ ID NO: 7344 - protein, 110 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCP

SEQ ID NO: 7345 - protein, 120 aa, Artificial Sequence
  Description of Artificial Sequence: Synthetic polypeptide
EVQLVESGGGLVQPGGSLRLSCAASGFTLSRFAMSWVRQAPGRGLEWVASINSGNNPYYARSVQYRFTVSRDVSQNTVSLQMNNLRAEDSATYFCAKDHPSSGWPTFDSWGPGTLVTVSS

SEQ ID NO: 7346 - protein, 113 aa, Artificial Sequence
  Description of Artificial Sequence: Synthetic polypeptide
DVVMTQTPLSLPVSLGDQASISCRSSQSLVHINGNTYLHWYLQKPGQSPKLLIYRVSNRFSGVPDRFSGSGSGTDFTLKISRVEAEDLGVYFCSQSTHVPWTFGGGTKLELKR

SEQ ID NO: 7347 - protein, 112 aa, Artificial Sequence
  Description of Artificial Sequence: Synthetic polypeptide
  MOD_RES (5)..(6): Any amino acid
  MOD_RES (33)..(33): Any amino acid
  MOD_RES (40)..(40): Any amino acid
  MOD_RES (91)..(91): Any amino acid
  MOD_RES (94)..(94): Any amino acid
  MOD_RES (108)..(108): Any amino acid
SAQIXXTQSPSSLSASLGERVSLTCRASQDIGXSLNWLQXEPDGTIKRLIYATSSLDSGVPKRFSGSRSGSDYSLTISSLESEDFVDYYCXQYXSSPFTFGSGTKLEXKRAA

SEQ ID NO: 7348 - protein, 112 aa, Artificial Sequence; identical to SEQ ID NO: 7233
  Description of Artificial Sequence: Synthetic polypeptide

SEQ ID NO: 7349 - protein, 112 aa, Artificial Sequence; identical to SEQ ID NO: 7233
  Description of Artificial Sequence: Synthetic polypeptide

SEQ ID NO: 7350 - protein, 108 aa, Artificial Sequence
  Description of Artificial Sequence: Synthetic polypeptide
DIVMTQSHKFMSTSVGDRVIITCKASQDVNTALAWYQQKPGQSPKLLIYSASYRYTGVPDRFTGSGSGTDFTFTISSVQAEDLAVYYCQQHYSTPPYTFGGGTKLEIK

SEQ ID NO: 7351 - protein, 106 aa, Artificial Sequence
  Description of Artificial Sequence: Synthetic polypeptide
QIVLTQSPAIMSASPGEKVTMTCSASSSVSYMYWYQQKPGSSPRVLIYDTSNLASGVPVRFSGSGSGTSYSLTISRMEAEDAATYYCQQWNGYPPTFGAGTKLEVK

SEQ ID NO: 7352 - protein, 106 aa, Artificial Sequence
  Description of Artificial Sequence: Synthetic polypeptide
QIVLTQSPAIMSASPGEEGTMTCSASSSVRYMYWYRQKPGSSPRLLIYDTSNLASGVPVRFSGSGSGTSYSLTISRMEAEDAATYYCQQWSSYPPTFGGGTKLEMK

SEQ ID NO: 7353 - protein, 108 aa, Artificial Sequence
  Description of Artificial Sequence: Synthetic polypeptide
DIVMTQSQKFMSTSVGDRVTITCKASQDVNTALAWYQQKPGQSPKLLIYSASYRYTGVPSRFSGSGSGTDFTFTISSVQAEDLAVYYCQQHYSTPPYTFGGGTKLEIK

SEQ ID NO: 7354 - protein, 106 aa, Artificial Sequence
  Description of Artificial Sequence: Synthetic polypeptide
EIVLTQSPATMSASPGERVTMSCSASSSVSYMYWYQQKPGQSPRVLIYDTSNLASGVPSRFSGSGSGTSYSLTISSMEPEDAATYYCQQWNGYPPTFGGGTKLEVK

SEQ ID NO: 7355 - protein, 106 aa, Artificial Sequence
  Description of Artificial Sequence: Synthetic polypeptide
EIVLTQSPGTMSASPGERGTMSCSASSSVRYMYWYRQKPGQSPRLLIYDTSNLASGVPARFSGSGSGTSYSLTISRMEAEDAATYYCQQWSSYPPTFGGGTKLEMK

SEQ ID NO: 7356 - protein, 106 aa, Artificial Sequence
  Description of Artificial Sequence: Synthetic polypeptide
QIVLSQSPAILSASPGEKVTMTCRASSSVNYMHWYQQKPGSSPKPWISATSNLASGVPARFSGSGSGTSYSLTISRVEAEDAATYYCQQWSSNPPTFGGGTMLEIR

SEQ ID NO: 7357 - protein, 106 aa, Artificial Sequence
  Description of Artificial Sequence: Synthetic polypeptide
DIVLSQSPAILSASPGEKVTMTCRASSSVSYMHWYQQKPGSSPKPWIYATSNLASGVPARFSGSGSGTSYSLTISRVEAEDAATYYCQQWSSNPPTFGGGTKLEIK

SEQ ID NO: 7358 - protein, 106 aa, Artificial Sequence
  Description of Artificial Sequence: Synthetic polypeptide
DIVLSQSPAILSASPGEKVTMTCRASSSVNYMHWYQQKPGSSPKPWISATSNLASGVPARFSGSGSGTSYSLTISRVEAEDAATYYCQQWSSNPPTFGGGTMLEIK

SEQ ID NO: 7359 - protein, 112 aa, Artificial Sequence; identical to SEQ ID NO: 7233
  Description of Artificial Sequence: Synthetic polypeptide

SEQ ID NO: 7360 - protein, 111 aa, Artificial Sequence
  Description of Artificial Sequence: Synthetic polypeptide
QPVLTQSPSASASLGASVKLTCTLDSEHSRYTIAWHQQQPEKGPRYLMKVKSDGSHSKGDGITDRFSGSSSGAERYLTISSLQSEDEADYYCQTWGPGIRVFGGGTKLTVL

SEQ ID NO: 7361 - protein, 112 aa, Artificial Sequence
  Description of Artificial Sequence: Synthetic polypeptide
QLVLTQSPSASASLGASVKLTCTLSSGHSTYAIAWHQQQPLRGPRFLMKVNSDGSHTKGDGIPDRFSGSSSGAERYLSISSLQSEDESDYYCQTWGPGIRVFGGGTKLTVLG

SEQ ID NO: 7362 - protein, 120 aa, Artificial Sequence
  Description of Artificial Sequence: Synthetic polypeptide
QLVLTQSPSASASLGASVKLTCTLSSGHSNYAIAWHQQQPGKGPRYLMKVNRDGSHIRGDGIPDRFSGSTSGAERYLTISSLQSEDEADYYCQTWGAGIRVFGGGTKLTVLGQPKAAPSV

SEQ ID NO: 7363 - protein, 120 aa, Artificial Sequence
  Description of Artificial Sequence: Synthetic polypeptide
QLVLTQSPSASASLGASVKLTCTLSSGHSTYAIAWHQQQPLRGPRFLMKVNSDGSHTKGDGIPDRFSGSSSGAERYLSISSLQSEDESDYYCQTWGPGIRVFGGGTKLTVLGQPKAAPSV

SEQ ID NO: 7364 - protein, 108 aa, Artificial Sequence
  Description of Artificial Sequence: Synthetic polypeptide
DILLTQSPAILSVSPGERVSFSCRASQSIGTSIHWYQQRTNGSPRLLIKYASESISGIPSRFSGSGSGTDFTLSINSVESEDIADYYCQQSNRWPFTFGSGTKLEIKR

SEQ ID NO: 7365 - protein, 107 aa, Artificial Sequence
  Description of Artificial Sequence: Synthetic polypeptide
QNVLTQSPAIMSASPGEKVTMTCSASSSVSYMHWYQQKSGTSPKRWIYDTSKLASGVPARFSGSGSGTSYSLTISSMEAEDAATYYCQQWSSNPLTFGAGTKLELKR

SEQ ID NO: 7366 - protein, 108 aa, Artificial Sequence; identical to SEQ ID NO: 7364
  Description of Artificial Sequence: Synthetic polypeptide

SEQ ID NO: 7367 - protein, 108 aa, Artificial Sequence
  Description of Artificial Sequence: Synthetic polypeptide
ETTLTQSPGTLSLSPGERATLSCRASQTISNNFVAWYQQKPGQAPRLLIYGASTRATGIPDRFSGSGSGTDFTLTISSLEPEDFAVYYCQQYGSSPYTFGQGTKVDIK

SEQ ID NO: 7368 - protein, 108 aa, Artificial Sequence
  Description of Artificial Sequence: Synthetic polypeptide
EIVLTQSPGTLSLSPGERATLSCRASQTISNNFVAWYQQKPGQAPRLLIYGASTRATGIPDRFSGSGSGTDFTLTISRLEPEDFAVYYCQQYGSSPYTFGQGTKLEIK

SEQ ID NO: 7369 - protein, 220 aa, Artificial Sequence
  Description of Artificial Sequence: Synthetic polypeptide
QSALTQPRSVSGSPGQSITISCTGTSSDVGSYNLVSWYQQHPGKAPKLMIYEVSKRPSGVSNRFSGSKSGNTASLTISGLQAEDEADYYCCSYAGSSWVFGTGTKVTVLKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7370 - protein, 215 aa, Artificial Sequence
  Description of Artificial Sequence: Synthetic polypeptide
STDIQMTQSPSTLSASVGDRVTITCRASQSISSWLAWYQQKPGKAPKLLIYKASSLESGVPSRFSGSGSGTEFTLTISSLQPDDFATYYCQQYNSYPLTFGGGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7371 - protein, 215 aa, Artificial Sequence
  Description of Artificial Sequence: Synthetic polypeptide
STEIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7372 - protein, 220 aa, Artificial Sequence
  Description of Artificial Sequence: Synthetic polypeptide
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNLVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7373 - protein, 216 aa, Artificial Sequence
  Description of Artificial Sequence: Synthetic polypeptide
QSVLTQPPSLSVSPGQTASISCSGDKLGDKYVSWYQQRPGQSPVLVIYHDTKRPSGIPERFSGTNSGNTATLTISGTQILDEADYYCQVWDRSTVVFGGGTQLTVLSAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7374 - protein, 214 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISSLEPEDFAVYYCQQYGSSSITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7375 - protein, 219 aa, Artificial Sequence
  Description of Artificial Sequence: Synthetic polypeptide
DIQLTQSPDSLAVSLGERATINCKSSQSLLYTSNNKNFLAWYQQKPGQPPKLLIYWVSTRDSGVPDRFSGSGSGTDFTLTISSLQAEDVAVYYCQQYYTTPYTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7376 - protein, 221 aa, Artificial Sequence
  Description of Artificial Sequence: Synthetic polypeptide
QSVLTQPPSVSGAPGQRVTISCTGSSSNIGAGYDVHWYQQLPGTAPKLLIYGNSNRPSGVPDRFSGSKSGTSASLAISGLRSGDEADYYCQSYDSSLSDVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7377 - protein, 220 aa, Artificial Sequence
  Description of Artificial Sequence: Synthetic polypeptide
QSALTQPASVSGSPGQTITISCSGTSSDVGGYNYVSWYQQHPGKAPKLMIYDVSKRPSGVSNRFSGSKSGNTASLTISGLQAEDEADYYCSSSTRSSTLVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7378 - protein, 220 aa, Artificial Sequence
  Description of Artificial Sequence: Synthetic polypeptide
QSALTQPPSASGSPGQSVTISCTGTSSDVGGYDYVSWYQQHPGKAPKLMIYDVSKRPSGVPDRFSGSKSGNTASLTISGLQAEDEADYYCSSYASNRDVLFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7379 - protein, 218 aa, Artificial Sequence; identical to SEQ ID NO: 7336
  Description of Artificial Sequence: Synthetic polypeptide

SEQ ID NO: 7380 - protein, 220 aa, Artificial Sequence
  Description of Artificial Sequence: Synthetic polypeptide
QSALTQPASVSGSPGQSITISCTGTSSDVGGYNYVSWYQQHPGKAPKLMIYDVIKRPSGVPDRFSGSKSGNTASLTISGLQAEDEADYYCSSYAGSNNVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7381 - protein, 220 aa, Artificial Sequence
  Description of Artificial Sequence: Synthetic polypeptide
QSALTQPPSASGSPGQSVTISCTGTSSDVGGYNYVSWYQQHPGKAPKLMIYDVSKRPSGVPDRFSGSKSGNTASLTVSGLQSEDEADYYCSSYAGSTGYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7382 - protein, 220 aa, Artificial Sequence
  Description of Artificial Sequence: Synthetic polypeptide
QSVLTQPPSASGSPGQSVTISCTGTSSDVGGYNYVSWYQQHPGKAPKLMIYEVTRRPSGVSYRFSGSKSGNTASLTVSGLQAEDEADYYCSSYAGSNNLVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7383 - protein, 220 aa, Artificial Sequence
  Description of Artificial Sequence: Synthetic polypeptide
QSVVTQPPSVSAAPGQKVTISCSGSSSNIGNNYVSWYQQLPGTAPKLLIYDNNKRPSGIPDRFSGSKSGTSATLGITGLQTGDEADYYCGTWESSLSAVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7384 - protein, 220 aa, Artificial Sequence
  Description of Artificial Sequence: Synthetic polypeptide
QSALTQPASVSGSPGQSITISCTGTSSDVGGYNYVSWYQHHPGKAPKLMIYDVSDRPSGVSNRFSGSKSGNAASLTISGLQAEDEADYYCSSYAGSNNLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7385 - protein, 213 aa, Artificial Sequence
  Description of Artificial Sequence: Synthetic polypeptide
DIQMTQSPSSVSASVGDRVTITCRASQGISSRLAWYQQKPGKAPKLLIYAASSLQSGVPSRFSGSGSGTDFTLTISSLQPEDFGTYYCQQAKNFPRTFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7386 - protein, 214 aa, Artificial Sequence
  Description of Artificial Sequence: Synthetic polypeptide
EIVLTQSPGTLSLSPGERATLSCRASQSVSSNYLAWYQQKPGQAPRLLVYGASSRATGIPDRFSGSGSGTDFTLTISRLEPEDFAVYHCQQYAGSPWTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7387 - protein, 220 aa, Artificial Sequence; identical to SEQ ID NO: 7372
  Description of Artificial Sequence: Synthetic polypeptide

SEQ ID NO: 7388 - protein, 220 aa, Artificial Sequence
  Description of Artificial Sequence: Synthetic polypeptide
QSALTQPRSVSGSPGQSVTISCTGTSSDIGGYNFVSWYQQHPGKAPKLMIYDVSNRPSGVSNRFSGSKSGKMASLTISGLQAEDEADYYCASYTSRSTLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7389 - protein, 213 aa, Artificial Sequence
  Description of Artificial Sequence: Synthetic polypeptide
DIQMTQSPSSLSASVGDRVTITCRASQSISSYLNWYQQKPGKAPKLLIYAASSLQSGVPSRFSGSGSGTDFTLTISSLQPEDFATYYCQQANSFPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7390 - protein, 220 aa, Artificial Sequence
  Description of Artificial Sequence: Synthetic polypeptide
QSALTQPPSASGSPGQSVTISCTGTSSDVGGYNYVSWYQHHPGKAPKLMIYDVSNRPSGVSNRFSGSKSGNTASLTISGLQAEDEADYYCSSYTSSSTLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7391 - protein, 221 aa, Artificial Sequence
  Description of Artificial Sequence: Synthetic polypeptide
QSALTQPPSASGSPGQSVTISCTGTSSDVGGYNYVSWYQQRPGKAPKLMIYDVSNRPSGVSDRFSGSKSGNTASLTISGLQAEDEADYYCSSYTTGSTLVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7392 - protein, 220 aa, Artificial Sequence
  Description of Artificial Sequence: Synthetic polypeptide
QSALTQPPSASGSPGQSVTISCTGTSSDVGGYNYVSWYQQHPGKAPKLMIYEVSKRPSGVPDRFSGSKSGNTASLTVSGLQAEDEADYYCSSYGGSNNVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7393 - protein, 220 aa, Artificial Sequence
  Description of Artificial Sequence: Synthetic polypeptide
QSALTQPASVSGSPGQSITISCTGTSSDVGAYNYVSWYQQHPGKAPKLMIYDVSNRPSGVSNRFSGSKSGNTASLTISGLQAEDEADYYCSSYAGSNSVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7394 - protein, 213 aa, Artificial Sequence
  Description of Artificial Sequence: Synthetic polypeptide
DIQLTQSPSSVSASVGGRVTITCRASQGISSWLAWYQQRPGKAPNLLIYGASNLQSGVPSRFSGSGSGTDFSLTISSLQPEDFATYYCQQAKSFPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7395 - protein, 219 aa, Artificial Sequence
  Description of Artificial Sequence: Synthetic polypeptide
DVVMTQSPDSLAVSLGERATINCKSSQSVFYSSNNKNYLAWYQHKPGQPPKLLIYWASTRQSGVPDRFSGSGSGTDFTLTINSLQAEDVAVYYCQQYYSTPPTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7396 - protein, 220 aa, Artificial Sequence
  Description of Artificial Sequence: Synthetic polypeptide
QSALTQPRSVSGSPGQAVTLSCNGTSRDVGGYNYVSWYQQHPGKAPKLMIYDVTKRPSGVPDRFSGSKSGNTASLTISGLQAEDEADYYCNSYAGSNTWVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7397 - protein, 220 aa, Artificial Sequence; identical to SEQ ID NO: 7381
  Description of Artificial Sequence: Synthetic polypeptide

SEQ ID NO: 7398 - protein, 220 aa, Artificial Sequence
  Description of Artificial Sequence: Synthetic polypeptide
QSALTQPPSASGSPGQSVTISCTGTSSDVGGYNYVSWYQQYPGKAPKLMIYDVSNRPSGVSNRFSGSKSGNTASLTISGLQAEDEADYYCSSYTSSSTLVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7399 - protein, 221 aa, Artificial Sequence
  Description of Artificial Sequence: Synthetic polypeptide
QSALTQPPSASGSPGQSVTISCTGTSSDIGGYNYVSWYQQHPGKAPKLMIYEVSNRPPGVSNRFSGSKSGNTASLTISGLQAEDEADYYCSSYSTTTTRVIFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7400 - protein, 220 aa, Artificial Sequence
  Description of Artificial Sequence: Synthetic polypeptide
QSVVTQPPSVSAAPGQKVTISCSGSTSNIGNYYVSWYQQLPGTAPKLLIYENNKRPSGIPDRFSGSKSGTSATLDITGLQTGDEADYYCGAWDGSLSAVVLGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7401 - protein, 220 aa, Artificial Sequence
  Description of Artificial Sequence: Synthetic polypeptide
QSALTQPRSVSGSPGQSVTISCTGTSSDVGGYNYVSWYQQHPGKAPKLMIYDVSNRPSGVSNRFSGSKSGNTASLTISGLQAEDEADYYCSSYTSSSTLVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7402 - protein, 451 aa, Artificial Sequence
  Description of Artificial Sequence: Synthetic polypeptide
EVQLVESGAEVKKPGESLKISCKGSGYSFTNYWIGWVRQMPGKGLEWMGIVYPGDSDTRYSPSFQGQVTISADKSISTAYLQWSSLKASDTAVYYCARRMAVAGSDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7403 - protein, 463 aa, Artificial Sequence
  Description of Artificial Sequence: Synthetic polypeptide
QVQLVQSGAEVKKPGASVKVSCKASGYTFTSYAISWVRQAPGQGLEWMGWISAYNGNTNYARKLQGRVTMTTDTSTSTAYMELRSLRSDDTAVYYCARAGLMFTAWFGELWDHGTKDNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7404 - protein, 451 aa, Artificial Sequence
  Description of Artificial Sequence: Synthetic polypeptide
EVQLVQSGAEVKKPGESLKISCKGSGYSFTKYWIGWVRQMPGKGLEWMGIIYPGDSDTRYSPSFQGQVTISADKSISTAYLQWSSLKASDTAMYYCARGSGIATGNSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7405 - protein, 453 aa, Artificial Sequence
  Description of Artificial Sequence: Synthetic polypeptide
EVQLVESGAEVKKPGESLKISCKGSGYSFTSYWIGWVRQMPGKGLEWMGIIYPGDSDTRYSPSFQGQVTISADKSISTAYLQWSSLKASDTAMYYCARRYCSGGTCSDGFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7406 - protein, 456 aa, Artificial Sequence
  Description of Artificial Sequence: Synthetic polypeptide
EVQLVESGPEVKKPGASVKVSCEASGYNLDNYGITWVRQAPGQGLEWLGWISAYNAKTEYGQRLQGRVTMTTDTATSTAYLELRSLRSDDTAVYYCARVLGYRGGWYDEGDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7407 - protein, 449 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREGGVGPAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7408 - protein, 446 aa, Artificial Sequence
  Description of Artificial Sequence: Synthetic polypeptide
EVQLVESGGGLVQPGGSLRLSCAASGFTFSSYAMSWVRQAPGKGLEWVSAISGTGGSAYYADSVKGRFTISRDNSKNTVYLQMNSLRAEDTAVYYCAKGHSSGTNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7409 - protein, 452 aa, Artificial Sequence
  Description of Artificial Sequence: Synthetic polypeptide
EVQLVESGGGLVKPGGSLRLSCAASGFTFSSNSMNWVRQAPGKGLEWVSFISSSSTYIYYADSVKGRFTISRDNAKNSLYLQMNSLRAEDTAVYYCARESAAGISYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7410 - protein, 451 aa, Artificial Sequence
  Description of Artificial Sequence: Synthetic polypeptide
EVQLVESGGGLVQPGRSLRLSCTGSGFTFGDYAMSWFRQAPGKGLEWVGFIRNKAYGGTAEYAASVKDRFIISRDDSKSIAYLQMNSLKTEDTAVYYCVRREYDTGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7411 - protein, 445 aa, Artificial Sequence
  Description of Artificial Sequence: Synthetic polypeptide
EVQLVESGGGVVQPGRSLRLSCAASGFTFSSYGMHWVRQAPGKGLEWVAVIWYDGSNKYYADSVKGRFTISRDNSQNTLYLQMNSLRAEDTAVYYCTSYAIAATPGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7412 - protein, 448 aa, Artificial Sequence
  Description of Artificial Sequence: Synthetic polypeptide
EVQLVESGGGLVQPGRSLRLSCAASGFTFRSYAMYWVRQAPGKGLEWLALISHDASKMFYADSVKGRFTISRDNSKNTLSLQMNSLTIEDTAVYYCVRERTGYYGAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7413 - protein, 451 aa, Artificial Sequence
  Description of Artificial Sequence: Synthetic polypeptide
EVQLVESGGGLIQPGGSLRLSCAASGFTVSSDFMTWVRQAPGRGLEWVSLIYSGGKTNYADSVKGRFTISRDNSRNTLYLQMNSLRAEDTAVYYCARSVCSTISCSKLDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7414 - protein, 449 aa, Artificial Sequence
  Description of Artificial Sequence: Synthetic polypeptide
EVQLVETGAEVKKPGESLRISCKGSGYSFTSYWIAWVRQMPGKGLEWMGVIYPGDSDARYSPSFQGQVTMSVDKSISTAYLQWSSLKASDTAMYYCAKLRSKNTGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7415 - protein, 451 aa, Artificial Sequence
  Description of Artificial Sequence: Synthetic polypeptide
QMQLVQSGAEVKKSGESLKISCKGSGYSFSTYWIGWVRQMPGKGLEWMGIIYPGDSDTRYNPSFQGQVTISADKSISTAYLQWSSLKASDTAMYYCARRSARGGNWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7416 - protein, 452 aa, Artificial Sequence; identical to SEQ ID NO: 7303
  Description of Artificial Sequence: Synthetic polypeptide

SEQ ID NO: 7417 - protein, 450 aa, Artificial Sequence
  Description of Artificial Sequence: Synthetic polypeptide
EVQLVESGAEVKKPGESLKISCKGSGYSFTSHWIGWVRQMPGKGLEWMGIIYPGDSDTRYSPSFQGQVTISVDKSISTAYLQWSSLKASDTAMYYCARLGSSRWSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7418 - protein, 450 aa, Artificial Sequence
  Description of Artificial Sequence: Synthetic polypeptide
QLQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARERILDRMNDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7419 - protein, 220 aa, Artificial Sequence
  Description of Artificial Sequence: Synthetic polypeptide
QAVLTQPSSASGTPGQTVTISCSGSTSNIGSHNVNWYQHLPGTAPKLLIYINNKRPSGVPDRFSGSKSGSSASLAISGLQSEDEADYYCAAWDDSLRRPVFGGGTQLTVLSAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7420 - protein, 220 aa, Artificial Sequence
  Description of Artificial Sequence: Synthetic polypeptide
NFMLTQPHSVSESPGKTVTISCTRSSGSIASYYVQWYQQRPGSSPTTVIYEDNQRPSGVPDRFSGSIDSSSNSASLTISGLKTEDEADYYCQSYDSSNQVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7421 - protein, 219 aa, Artificial Sequence
  Description of Artificial Sequence: Synthetic polypeptide
QTVVTQEPSLTVSPGGTVTLTCASSTGAVTSGYYPNWFQQKPGQAPRALIYSTSKKHSWTPARFSGSLLGGRAALTLSGAQPEDEADYYCLLSYGGARVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7422 - protein, 220 aa, Artificial Sequence; identical to SEQ ID NO: 7372
  Description of Artificial Sequence: Synthetic polypeptide

SEQ ID NO: 7423 - protein, 213 aa, Artificial Sequence
  Description of Artificial Sequence: Synthetic polypeptide
DIQLTQSPSFLSASVGDRVTITCRASQGIRSHLAWYQQKAGKAPKLLIYAASTLQSGVPSRFSGSGSGTEFTLTISSLQPDDFAAYYCQQLNTYPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7424 - protein, 219 aa, Artificial Sequence
  Description of Artificial Sequence: Synthetic polypeptide
DIQMTQSPDSLAVSLGERATINCKSSQSVLHNSNNKNYLAWYQQKPGQPPKLLIYWASTRESGVPDRFSGSGSGTDFTLTISSLQAEDVAVYYCQQYYGSPYTFGQGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7425 - protein, 220 aa, Artificial Sequence
  Description of Artificial Sequence: Synthetic polypeptide
SYVLTQPPSASGTPGQRVTISCSGSSSNIGSNFVYWYQQLPGTAPKLLIYRNNQRPSGVPDRFSGSKSGTSASLAISGLRSEDEADYYCAAWDDSLSGVLFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7426 - protein, 221 aa, Artificial Sequence
  Description of Artificial Sequence: Synthetic polypeptide
QSALTQPASVSGSPGQSITISCTGTSSDVGGYKYVSWYQQHPGKAPKLMIYEVSNRPSGVSNRFSGSKSGSTASLTISGLQAEDEADYYCSSYTSSSTLGVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7427 - protein, 221 aa, Artificial Sequence
  Description of Artificial Sequence: Synthetic polypeptide
QSALTQPPSASGSPGQSVTISCTGTSSDVGGYNYVSWYQRHPGKAPKLMIYDVTDRPSGVSNRFSGSKSGNTASLTISGLQAEDEADYYCSSYTSSSTSAVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7428 - protein, 220 aa, Artificial Sequence
  Description of Artificial Sequence: Synthetic polypeptide
QSVVTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7429 - protein, 213 aa, Artificial Sequence
  Description of Artificial Sequence: Synthetic polypeptide
DIQMTQSPSSLSASVGDRVTLTCRASQGIGTWLAWYQQKPGKAPKLLIYSASSLQSGVPSRFSGSGSGTDFTLSISNLQPEDFATYYCQQANSFPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7430 - protein, 218 aa, Artificial Sequence
  Description of Artificial Sequence: Synthetic polypeptide
QAVLTQPSSVSVAPGQTARITCGGNNIGRKSVHWYQQKPGLAPVLVVNDNSDRPSGIPARFSGSNSGNTATLTISRVEAGDEADYYCHVWGSSRDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7431 - protein, 220 aa, Artificial Sequence
  Description of Artificial Sequence: Synthetic polypeptide
QSALTQPPSASGSPGQSVTISCTGTSSDVGGYNFVSWYQQHPGKAPKLMIYEVSNRPSGVPDRFSGSKSGNTASLTVSGLQAEDEADYYCSSYAGNNNLAFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7432 - protein, 214 aa, Artificial Sequence
  Description of Artificial Sequence: Synthetic polypeptide
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7433 - protein, 221 aa, Artificial Sequence; identical to SEQ ID NO: 7399
  Description of Artificial Sequence: Synthetic polypeptide

SEQ ID NO: 7434 - protein, 220 aa, Artificial Sequence
  Description of Artificial Sequence: Synthetic polypeptide
QSALTQPPSASGSPGQSVTISCTGTSTDVGGYNYVSWYQHHPGKAPKLVIYGVSKRPSRVPDRFSGSKSGNTASLTVSGLQAEDEADYYCSSYAGSNNLVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7435 - protein, 220 aa, Artificial Sequence
  Description of Artificial Sequence: Synthetic polypeptide
QSVVTQPPSVSGAPGQRVTISCTGSSSNIGAGYDVHWYQQLPGTAPKLLIYGNSNRPSGVPDRFSGSKSGTSASLAITGLQAEDEADYYCQSSDSSLNILFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7436 - protein, 110 aa, Artificial Sequence
  Description of Artificial Sequence: Synthetic polypeptide
  MOD_RES (92)..(92): Any amino acid
DIQLTQSPSALPASVGDRVSITCRASENVGDWLAWYRQKPGKAPNLLIYKTSILESGVPSRFSGSGSGTEFTLTISSLQPDDFATYYCQHYXRFPYTFGQGTKLEIKRTV

SEQ ID NO: 7437 - protein, 109 aa, Artificial Sequence
  Description of Artificial Sequence: Synthetic polypeptide
  MOD_RES (92)..(92): Any amino acid
DIQLTQSPSALPASVGDRVSITCRASENVGDWLAWYRQKPGKAPNLLIYKTSILESGVPSRFSGSGSGTEFTLTISSLQPDDFATYYCQHYXRFPYTFGQGTKLEIKRA

SEQ ID NO: 7438 - protein, 110 aa, Artificial Sequence
  Description of Artificial Sequence: Synthetic polypeptide
  MOD_RES (92)..(92): Any amino acid
DIQLTQSPSALPASVGDRVSITCRASENVGDWLAWYRQKPGKAPNLLIYKTSILESGVPSRFSGSGSGTEFTLTISSLQPDDFATYYCQHYXRFPYTFGQGTKVEIKRTV

SEQ ID NO: 7439 - protein, 213 aa, Artificial Sequence
  Description of Artificial Sequence: Synthetic polypeptide
DIQLTQSPSALPASVGDRVSITCRASENVGDWLAWYRQKPGKAPNLLIYKTSILESGVPSRFSGSGSGTEFTLTISSLQPDDFATYYCQHYMRFPYTFGQGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7440 - protein, 214 aa, Artificial Sequence
  Description of Artificial Sequence: Synthetic polypeptide
DIQLTQSPSALPASVGDRVSITCRASENVGDWLAWYRQKPGKAPNLLIYKTSILESGVPSRFSGSGSGTEFTLTISSLQPDDFATYYCQHYMRFPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPCTKSFNRGEC

SEQ ID NO: 7441 - protein, 104 aa, Artificial Sequence
  Description of Artificial Sequence: Synthetic polypeptide
AAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7442 - protein, 242 aa, Artificial Sequence
  Description of Artificial Sequence: Synthetic polypeptide
QVQLQESGPGLVKPSQTLSLTCTVSGGSISSGGYYWSWIRQPPGKGLEWIGYIYYSGSTYYNSSLKSRVTISVDTSKNQFSLKLSSVTAADTAVYYCAKTVMNSFFDWGQGTLVTVSSGGGGSGGGGSGGGGSEIELTQPPSVSGSPGQSITISCTGTSSDVGSYNLVSWYQQHPGKAPKLMIYEVSKRPSGVSNRFSGSKSGNTASLTISGLQAEDEADYYCCSYAGSSWVFGGGTKLTVL

SEQ ID NO: 7443 - protein, 242 aa, Artificial Sequence
  Description of Artificial Sequence: Synthetic polypeptide
EVLESGGGLVQPGGSLRLSCSDSGFSFNNYWMTWVRQAPGKGLEWVANINRDGSDKYHVDSVEGRFTISRDNSKNSLYLQMNNLRADDAAVYFCARGGRTTSWYWRNWGQGTLVTVSSGTGGSGGTGSGTGGSTDIQMTQSPSTLSASVGDRVTITCRASQSISSWLAWYQQKPGKAPKLLIYKASSLESGVPSRFSGSGSGTEFTLTISSLQPDDFATYYCQQYNSYPLTFGGGTKLEIKR

SEQ ID NO: 7444 - protein, 244 aa, Artificial Sequence
  Description of Artificial Sequence: Synthetic polypeptide
EVQLVETGGGLVKPGGSLRLSCSASRFSFRDYYMTWIRQAPGKGPEWVSHISGSGSTIYYADSVRGRFTISRDNAKSSLYLQMDSLQADDTAVYYCARGGRATSYYWVHWGPGTLVTVSSGTGGSGGTGSGTGGSTEIVLTQSPATLSLSPGERATLSCRASQSVSGYLGWYQQKPGQAPRLLIYGASSRATGIPDRFSGSGSGTDFTLTISRLEPEDFAVYYCQQYGSSPLTFGGGTKLEIKR

SEQ ID NO: 7445 - protein, 243 aa, Artificial Sequence
  Description of Artificial Sequence: Synthetic polypeptide
EVQLVESGGVAVQPGRSLRLSCAASGFSFRDYGMHWVRQAAGKGLEWVAFIWPHGVNRFYADSMEGRFTISRDDSKNMLYLEMNNLRTEDTALYYCTRDQDYVPRKYFDLWGRGTLVTVSSGTGGSGGTGSGTGGSTSYVLTQPPSVSVAPGQTARITCGGNNIGSKSVHWYQQKPGQSPVLVMYQDRRRPSGIPERFSGSNSGHTATLTISGTQAMDEADYYCQAWDSSTGVFGTGTQLTVL

SEQ ID NO: 7446 - protein, 247 aa, Artificial Sequence
  Description of Artificial Sequence: Synthetic polypeptide
EVQLVESGAEVKKPGESLKISCKGSGYSFTNYWIGWVRQMPGKGLEWMGIVYPGDSDTRYSPSFQGQVTISADKSISTAYLQWSSLKASDTAVYYCARRMAVAGSDAFDIWGQGTMVTVSSGTGGSGGTGSGTGGSTQAVLTQPSSASGTPGQTVTISCSGSTSNIGSHNVNWYQHLPGTAPKLLIYINNKRPSGVPDRFSGSKSGSSASLAISGLQSEDEADYYCAAWDDSLRRPVFGGGTQLTVL

SEQ ID NO: 7447 - protein, 249 aa, Artificial Sequence
  Description of Artificial Sequence: Synthetic polypeptide
QVQLVQSGAEVKKPGATVKISCKVSGYTFTDYYMHWVQQAPGKGLEWMGLVDPEDGETIYAEKFQGRVTITADTSTDTAYMELSSLRSDDTAVYYCARAEVMTTINNWYFDLWGRGTLVTVSSGTGGSGGTGSGTGGSTSYVLTQPPSASGTPGQRVTISCSGSSSNIGSNNVSWYQQLPGTAPKLLIYSNNQRPSGVPDRFSGSKSGTSASLAISGLQSEDEADYYCAAWDDSLNGWVFGGGTKLTVL

SEQ ID NO: 7448 - protein, 259 aa, Artificial Sequence
  Description of Artificial Sequence: Synthetic polypeptide
QVQLVQSGAEVKKPGASVKVSCKASGYTFTSYAISWVRQAPGQGLEWMGWISAYNGNTNYARKLQGRVTMTTDTSTSTAYMELRSLRSDDTAVYYCARAGLMFTAWFGELWDHGTKDNWFDPWGQGTLVTVSSGTGGSGGTGSGTGGSTNFMLTQPHSVSESPGKTVTISCTRSSGSIASYYVQWYQQRPGSSPTTVIYEDNQRPSGVPDRFSGSIDSSSNSASLTISGLKTEDEADYYCQSYDSSNQVFGGGTKLTVL

SEQ ID NO: 7449 - protein, 244 aa, Artificial Sequence
  Description of Artificial Sequence: Synthetic polypeptide
EVQLVESGGGLVKPGGSLGLSCAASGFFFSDYSMSWIRQAPGKGLEWLSNISGSGHSTKYAESMRGRITISRDNAKKSLSLQLNSLRAEDTAVYFCVRGGGYRMDVWGQGTTVTVSSGTGGSGGTGSGTGGSTQSALTQPRSVPGSPGQSVTISCTGTSSDVGGYNYVSWYQQHPGKAPKLMIYDVSKRPSGVPDRFSGSKSGNTASLTVSGLQAEDEADYYCSSYAGSNNFVVFGGGTKLTVL

SEQ ID NO: 7450 - protein, 246 aa, Artificial Sequence
  Description of Artificial Sequence: Synthetic polypeptide
EVQLVQSGAEVKKPGESLKISCKGSGYSFTKYWIGWVRQMPGKGLEWMGIIYPGDSDTRYSPSFQGQVTISADKSISTAYLQWSSLKASDTAMYYCARGSGIATGNSFDSWGQGTLVTVSSGTGGSGGTGSGTGGSTQTVVTQEPSLTVSPGGTVTLTCASSTGAVTSGYYPNWFQQKPGQAPRALIYSTSKKHSWTPARFSGSLLGGRAALTLSGAQPEDEADYYCLLSYGGARVFGGGTKLTVL

SEQ ID NO: 7451 - protein, 241 aa, Artificial Sequence
  Description of Artificial Sequence: Synthetic polypeptide
QVQLVQSGPEVKKPGASVTVSCKASGYSFSSYGISWVRQAPGQGLEWMGRIIPVGGNTLYSQMFQGRVTMTSDTSTSTVYLELSSLRSEDTAVYFCARDGGRWQFDYWGQGTLVTVSSGTGGSGGTGSGTGGSTDIQLTQSPSSVSASVGDRVTITCRASQGISNWLAWYQQKPGKAPELLIYAASSLQSGVPPRFSGSASGTDFTLTISSLQPEDFATYYCQQSKNFPYTFGQGTKVEIK

SEQ ID NO: 7452 - protein, 249 aa, Artificial Sequence
  Description of Artificial Sequence: Synthetic polypeptide
EVQLVESGAEVKKPGESLKISCKGSGYSFTSYWIGWVRQMPGKGLEWMGIIYPGDSDTRYSPSFQGQVTISADKSISTAYLQWSSLKASDTAMYYCARRYCSGGTCSDGFDIWGQGTMVTVSSGTGGSGGTGSGTGGSTQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNLVFGGGTKLTVL

SEQ ID NO: 7453 - protein, 246 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSIGTAYLQWSSLKASDTAMYYCARLFRVRGGHFDSWGQGTLVTVSSGTGGSGGTGSGTGGSTQSALTQPASVSGSPGQSITISCTGTNSDVGGYNYVSWYQQHPGKAPKLLIYDVTNRPSGVSNRFSASKSGNTASLTISGLQAEDEADYYCSSFTSSSTRVFGGGTKLTVL

SEQ ID NO: 7454 - protein, 249 aa, Artificial Sequence
  Description of Artificial Sequence: Synthetic polypeptide
EVQLVESGPEVKKPGASVKVSCEASGYNLDNYGITWVRQAPGQGLEWLGWISAYNAKTEYGQRLQGRVTMTTDTATSTAYLELRSLRSDDTAVYYCARVLGYRGGWYDEGDAFDVWGQGTMVTVSSGTGGSGGTGSGTGGSTDIQLTQSPSFLSASVGDRVTITCRASQGIRSHLAWYQQKAGKAPKLLIYAASTLQSGVPSRFSGSGSGTEFTLTISSLQPDDFAAYYCQQLNTYPITFGQGTRLEIK

SEQ ID NO: 7455 - protein, 248 aa, Artificial Sequence
  Description of Artificial Sequence: Synthetic polypeptide
EVQLVESGGGVVQPGRSLRLSCAASGFTFSSYGMHWVRQAPGKGLEWVAMIWSDGSNKYYADSVKGRFTISRDNSKNTLYLQMNSLRVEDTAVYYCASNYGSGSYWGGFDYWGQGTLVTVSSGTGGSGGTGSGTGGSTQSALTQPASVSGSPGQSITISCTGTSSDVGGYNLVSWYQQHPGKAPKLMIYEGSKRPSGVSNRFFGSKSGDTASLTISGLQAEDEADYYCSSYTTSSTHVFGTGTKVTVL

SEQ ID NO: 7456 - protein, 248 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREGGVGPAFDIWGQGTMVTVSSGTGGSGGTGSGTGGSTDIQMTQSPDSLAVSLGERATINCKSSQSVLHNSNNKNYLAWYQQKPGQPPKLLIYWASTRESGVPDRFSGSGSGTDFTLTISSLQAEDVAVYYCQQYYGSPYTFGQGTKLEIK

SEQ ID NO: 7457 - protein, 245 aa, Artificial Sequence
  Description of Artificial Sequence: Synthetic polypeptide
EVQLVESGAEVKKPGSSVKVSCKASGGTFSSYAISWVRQAPGQGLEWMGGIIPIFGTANYAQKFQGKVTITADESTSTAYMELSSLRSEDTAVYYCARLSPRYYGMDVWGQGTTVTVSSGTGGSGGTGSGTGGSTQSALTQPRSVSGSPGQSVTISCTGTSSDVGGYNYVSWYQQHPGKAPKLMIYGGSERPSGVSNRFSGSKSGNTASLTISGVQAEDEADYYCSSYTSSGTLLFGGGTQLTVL

SEQ ID NO: 7458 - protein, 242 aa, Artificial Sequence
  Description of Artificial Sequence: Synthetic polypeptide
EVQLVESGGGLVQPGGSLRLSCAASGFTFSSYAMSWVRQAPGKGLEWVSAISGTGGSAYYADSVKGRFTISRDNSKNTVYLQMNSLRAEDTAVYYCAKGHSSGTNWGQGTLVTVSSGTGGSGGTGSGTGGSTSYVLTQPPSASGTPGQRVTISCSGSSSNIGSNFVYWYQQLPGTAPKLLIYRNNQRPSGVPDRFSGSKSGTSASLAISGLRSEDEADYYCAAWDDSLSGVLFGGGTQLTVL

SEQ ID NO: 7459 - protein, 243 aa, Artificial Sequence
  Description of Artificial Sequence: Synthetic polypeptide
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARGYAATDYGMDVWGQGTTVTVSSGTGGSGGTGSGTGGSTDIQLTQSPSTLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK

SEQ ID NO: 7460 - protein, 249 aa, Artificial Sequence
  Description of Artificial Sequence: Synthetic polypeptide
EVQLVESGGGLVKPGGSLRLSCAASGFTFSSNSMNWVRQAPGKGLEWVSFISSSSTYIYYADSVKGRFTISRDNAKNSLYLQMNSLRAEDTAVYYCARESAAGISYDAFDIWGQGTMVTVSSGTGGSGGTGSGTGGSTQSALTQPASVSGSPGQSITISCTGTSSDVGGYKYVSWYQQHPGKAPKLMIYEVSNRPSGVSNRFSGSKSGSTASLTISGLQAEDEADYYCSSYTSSSTLGVFGTGTKVTVL

SEQ ID NO: 7461 - protein, 247 aa, Artificial Sequence
  Description of Artificial Sequence: Synthetic polypeptide
EVQLVETGGGLVQPGGSLRLSCAASGFTFSSYSMNWVRQAPGKGLEWVSFISSSSSTIYYADSVKGRFTIARDNAKNSLYLQMNSLRDEDTAVYYCARPVGTGISLFHAFDIWGQGTMVTVSSGTGGSGGTGSGTGGSTQSVLTQPPSVSVAPGQTARITCGGNNIGSKYVHWYQQKPGQAPVLVVYDDSDRPSGIPERFSGSNSGNTATLTISRVEAGDEADFYCQVWDGSSDPVVFGGGTKLTVL

SEQ ID NO: 7462 - protein, 248 aa, Artificial Sequence
  Description of Artificial Sequence: Synthetic polypeptide
EVQLVESGGGLVQPGRSLRLSCTGSGFTFGDYAMSWFRQAPGKGLEWVGFIRNKAYGGTAEYAASVKDRFIISRDDSKSIAYLQMNSLKTEDTAVYYCVRREYDTGWLDYWGQGTLVTVSSGTGGSGGTGSGTGGSTQSALTQPPSASGSPGQSVTISCTGTSSDVGGYNYVSWYQRHPGKAPKLMIYDVTDRPSGVSNRFSGSKSGNTASLTISGLQAEDEADYYCSSYTSSSTSAVFGGGTKLTVL

SEQ ID NO: 7463 - protein, 243 aa, Artificial Sequence
  Description of Artificial Sequence: Synthetic polypeptide
EVQLVESGGGVVQPGRSLRLSCVASEFTFSNYGMHWVRQAPGKGLEWVAVIWYDGSNEDYADSVKGRFTISRDNSKNTVYLHMNSLRAEDTAVYFCTRGQYSSTWFLDYWGQGTLVTVSSGTGGSGGTGSGTGGSTDIQLTQSPSTLSASVGDRVTITCRASQSISSWLAWYQQKPGKAPKLLIYKASSLETGVPSRFSGSGSGTDFTLTISSLQPEDFATYYCQQANSFPLTFGGGTKVDIK

SEQ ID NO: 7464 - protein, 241 aa, Artificial Sequence
  Description of Artificial Sequence: Synthetic polypeptide
EVQLVESGGGVVQPGRSLRLSCAASGFTFSSYGMHWVRQAPGKGLEWVAVIWYDGSNKYYADSVKGRFTISRDNSQNTLYLQMNSLRAEDTAVYYCTSYAIAATPGQGTLVTVSSGTGGSGGTGSGTGGSTQSVVTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTQLTVL

SEQ ID NO: 7465 - protein, 243 aa, Artificial Sequence
  Description of Artificial Sequence: Synthetic polypeptide
QLQLQESGPGLVKPSETLSLTCAVSGYSITSGYYWGWVRQPPGKGLEWIGSIYHTGSTYYNPSLKSRVTISVDTSKNQFSLKLNSLTAADTAVYFCASQSPAFDFWGQGTMVTVSSGTGGSGGTGSGTGGSTQSVLTQPPSVSGAPGQRVTISCTGSSSNIGTGYDVHWYQQLPGTAPKLLIYGNNNRPSGVPDRFSGSKSGTSASLAITGLQAEDEADYYCATWDDSLNGWVFGGGTKLTVP

SEQ ID NO: 7466 - protein, 241 aa, Artificial Sequence
  Description of Artificial Sequence: Synthetic polypeptide
EVQLVESGGGLVQPGRSLRLSCAASGFTFRSYAMYWVRQAPGKGLEWLALISHDASKMFYADSVKGRFTISRDNSKNTLSLQMNSLTIEDTAVYYCVRERTGYYGAYWGQGTLVTVSSGTGGSGGTGSGTGGSTDIQMTQSPSSLSASVGDRVTLTCRASQGIGTWLAWYQQKPGKAPKLLIYSASSLQSGVPSRFSGSGSGTDFTLSISNLQPEDFATYYCQQANSFPITFGQGTRLEIK

SEQ ID NO: 7467 - protein, 237 aa, Artificial Sequence
  Description of Artificial Sequence: Synthetic polypeptide
EVQLVESGPGLVKPSETLSLTCTVSGGSISSYYWSWIRQPPGKGLEWIGYIYYTGTTNYNPSLNSRVTISADTSKNQFSLKLSSVTAADTAVYYCARGGQTAGVWGKGTTVTVSSGTGGSGGTGSGTGGSTQSVLTQPPSVSVAPGQTARITCGGYNIGRKSVHWYQQKPGLAPVLVVYDNSDRPSGIPARFSGSNSGNTATLTISGTQAMDEADYYCQAWDRGTAVFGTGTKVTVL

SEQ ID NO: 7468 - protein, 245 aa, Artificial Sequence
  Description of Artificial Sequence: Synthetic polypeptide
EVQLVESGGGLIQPGGSLRLSCAASGFTVSSDFMTWVRQAPGRGLEWVSLIYSGGKTNYADSVKGRFTISRDNSRNTLYLQMNSLRAEDTAVYYCARSVCSTISCSKLDDWGQGTLVTVSSGTGGSGGTGSGTGGSTQAVLTQPSSVSVAPGQTARITCGGNNIGRKSVHWYQQKPGLAPVLVVNDNSDRPSGIPARFSGSNSGNTATLTISRVEAGDEADYYCHVWGSSRDHYVFGTGTKVTVL

SEQ ID NO: 7469 - protein, 241 aa, Artificial Sequence
  Description of Artificial Sequence: Synthetic polypeptide
EVQLVETGGGLVQPGGSLRLSCAASGLTFSSYAMSWVRQAPGKGLEWVSALSGSTTFYADSVKGRFTISRDNAKNTLYLQMNSLRAEDTAVYYCARGNYYGMDVWGQGTTVTVSSGTGGSGGTGSGTGGSTSYVLTQPPSASGTPGQRVTISCSGSSSNIGKFYVYWYQQFPGAAPKLLIYSNNQRPSGVPDRFSGSKSGTSASLAISGLQSEDEADYYCAAWDGSLNGYVFGTGTKVTVL

SEQ ID NO: 7470 - protein, 245 aa, Artificial Sequence
  Description of Artificial Sequence: Synthetic polypeptide
EVQLVETGAEVKKPGESLRISCKGSGYSFTSYWIAWVRQMPGKGLEWMGVIYPGDSDARYSPSFQGQVTMSVDKSISTAYLQWSSLKASDTAMYYCAKLRSKNTGLDYWGQGTLVTVSSGTGGSGGTGSGTGGSTQSALTQPPSASGSPGQSVTISCTGTSSDVGGYNFVSWYQQHPGKAPKLMIYEVSNRPSGVPDRFSGSKSGNTASLTVSGLQAEDEADYYCSSYAGNNNLAFGGGTQLTVL

SEQ ID NO: 7471 - protein, 245 aa, Artificial Sequence
  Description of Artificial Sequence: Synthetic polypeptide
QVQLVQSGAEVKKPGESLKISCKGSGYSFSTYWIGWVRQMPGKGLEWMGIIYPGDSDTRYSPSFQGQVTISADKSISTAHLQWSSLKASDTAMYYCARPGPRGYNHGFDYWGQGTLVTVSSGTGGSGGTGSGTGGSTSSELTQDPAESVALGQTVKITCQGDSLRRYYASWYQQKPGQAPVLVIYGKNNRPSGIPDRFSGSRSGNTASLTITGAQAEDEAVYYCNSRDSSGNSVVFGGGTKLTVL

SEQ ID NO: 7472 - protein, 245 aa, Artificial Sequence
  Description of Artificial Sequence: Synthetic polypeptide
QMQLVQSGAEVKKSGESLKISCKGSGYSFSTYWIGWVRQMPGKGLEWMGIIYPGDSDTRYNPSFQGQVTISADKSISTAYLQWSSLKASDTAMYYCARRSARGGNWYFDLWGRGTLVTVSSGTGGSGGTGSGTGGSTEIVLTQSPGTLSLSPGERATLSCRASQSVSSSYLAWYQQKPGQAPRLLIYGASSRATGIPDRFSGSGSGTDFTLTISRLEPEDFAVYYCQQYGRSPLTFGGGTKVEIK

SEQ ID NO: 7473 - protein, 255 aa, Artificial Sequence
  Description of Artificial Sequence: Synthetic polypeptide
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWGGVCSSTSCPNRDAFDIWGQGTMVTVSSGTGGSGGTGSGTGGSTQSALTQPRSVSGSPGQSVTISCTGTSSDVGGYNYVSWYQQHPGKAPKLMIYDVSNRPSGVSNRFSGSKSGNTASLTISGLQAEDEAEFHCSSYRSSGASPVVFGGGTKLTVL

SEQ ID NO: 7474 - protein, 249 aa, Artificial Sequence
  Description of Artificial Sequence: Synthetic polypeptide
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHTQNKNGMNTFDIWGQGTMVTVSSGTGGSGGTGSGTGGSTQSALTQPPSASGSPGQSVTISCTGTSSDIGGYNYVSWYQQHPGKAPKLMIYEVSNRPPGVSNRFSGSKSGNTASLTISGLQAEDEADYYCSSYSTTTTRVIFGGGTKLTVL

SEQ ID NO: 7475 - protein, 242 aa, Artificial Sequence
  Description of Artificial Sequence: Synthetic polypeptide
EVQLVESGGGLVQPGRSLRLSCAASGFTFDDYAMHWVRQAPGKGLEWVSGISWNSGSIGYADSVKGRFTISRDNAKNSLYLQMNSLRAEDSAVYYCARGGQRFDFWGQGTLVTVSSGTGGSGGTGSGTGGSTQSALTQPPSASGSPGQSVTISCTGTSSDVGGYNYVSWYQQLPGKAPKLLIYDVNNRPSGVSNRFSGSKSGNTASLTISGLQAEDEAEYYCGSSVGSRLRIFGGGTKLTVL

SEQ ID NO: 7476 - protein, 246 aa, Artificial Sequence
  Description of Artificial Sequence: Synthetic polypeptide
EVQLVESGAEVKKPGESLKISCKGSGYSFTSHWIGWVRQMPGKGLEWMGIIYPGDSDTRYSPSFQGQVTISVDKSISTAYLQWSSLKASDTAMYYCARLGSSRWSHFDYWGQGTLVTVSSGTGGSGGTGSGTGGSTQSALTQPPSASGSPGQSVTISCTGTSTDVGGYNYVSWYQHHPGKAPKLVIYGVSKRPSRVPDRFSGSKSGNTASLTVSGLQAEDEADYYCSSYAGSNNLVFGGGTKLTVL

SEQ ID NO: 7477 - protein, 249 aa, Artificial Sequence
  Description of Artificial Sequence: Synthetic polypeptide
QVQLVQSGAEVKNPGESLKISCKGSGYTFTSYWIGWVRQMPGKGLEWMGSIYPGDSDTRYSPSFQGQVTISVDKSISTAYLQWSSLKASDTAMYYCARQYRAGSTTRFDPWGQGTLVTVSSGTGGSGGTGSGTGGSTDVVMTQSPLSLPVTPGEPASISCRSSQSLRHRNGNNYLDWYLQKPGQSPQLLIYLGSNRASGVPDRFSGSGSGTDFTLKISRVEAEDVGIYYCMQALQTPLTFGGGTKVEIK

SEQ ID NO: 7478 - protein, 246 aa, Artificial Sequence
  Description of Artificial Sequence: Synthetic polypeptide
QLQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARERILDRMNDYWGQGTLVTVSSGTGGSGGTGSGTGGSTQSVVTQPPSVSGAPGQRVTISCTGSSSNIGAGYDVHWYQQLPGTAPKLLIYGNSNRPSGVPDRFSGSKSGTSASLAITGLQAEDEADYYCQSSDSSLNILFGGGTKLTVL

SEQ ID NO: 7479 - protein, 123 aa, Artificial Sequence
  Description of Artificial Sequence: Synthetic polypeptide
QVQLQESGPGLVKPSQTLSLTCTVSGGSISSGSYYWNWIRQPAGKGLEWIGRIYTSGRTNYNPSLKSRVTVSVDTSKNQFSLRLSSVTAADTAVYYCAREDAGEDIVNWFDPWGQGTLVTVSS

SEQ ID NO: 7480 - protein, 123 aa, Artificial Sequence
  Description of Artificial Sequence: Synthetic polypeptide
QVKLLEQSGGGVVQPGRSLRLSCAASGIFTLTYGIHWVRQAPGKGLEWVAGLWYGTNKNYAESVKGRFTISRDNSKDTLYLMNSLRADDTAVYYCARALQGLIHEMDDWGKGTAVTVSSASTK

SEQ ID NO: 7481 - protein, 147 aa, Artificial Sequence
  Description of Artificial Sequence: Synthetic polypeptide
EFMEFGLTWLSLVAILKGVQCEVQLLESGGDLVQPGRSLRLSCTASGFTFGNYALSWVRQSPGKGLEWVSVISGSAGSRYYADSVKGRFTISRDNSKNTLSLHMNSLRAEDTAVYYCARLYSGSPTSSASTKGPSVFPLAPSSKSKL

SEQ ID NO: 7482 - protein, 119 aa, Artificial Sequence
  Description of Artificial Sequence: Synthetic polypeptide
QVQLQESGPGLVKPSETLSLTCTISGGSISNHYWNWIRQSPGKGLEWIGYVYYSGSFNYNPSLKSRLSISMDTSKIQFSLHLSSVTAADTAVYYCARARRGKSGYVSSFDIWGQGTAVT

SEQ ID NO: 7483 - protein, 123 aa, Artificial Sequence
  Description of Artificial Sequence: Synthetic polypeptide
EVQLVETGPGLVKPSGTLSLTCAVSGASISSSNWWSWVRQSPGKGLEWIGEISHSGNINYNPSLQSRVSISVDKTKNILSLRLTSVTAADTAVYYCARRTYYYGSENYRRGWFDPWGQGTQVT

SEQ ID NO: 7484 - protein, 118 aa, Artificial Sequence
  Description of Artificial Sequence: Synthetic polypeptide
EVQLVESGGGLVKPGGSLRLFCSASGFTFRDYYMSWIRQAPGQALEWVSSISYGSNIIYYADSVKGRFTISRDDAKNSLFLQMNNLRAEDTAVYYCARIYDIFTGYPLDYWGQGTLVT

SEQ ID NO: 7485 - protein, 118 aa, Artificial Sequence
  Description of Artificial Sequence: Synthetic polypeptide
EVQLVESGGGLVQPGESLRLSCAASGFTFSGHAMSWVRQAPGKGLEWVSTISGSGGSTYYADSVRGRFTISRDNSKNTLYLQMNSLRAEDTAMFYCARTPGQWELSYWGYWGQGTLVT

SEQ ID NO: 7486 - protein, 112 aa, Artificial Sequence
  Description of Artificial Sequence: Synthetic polypeptide
EVQLVESGGGLVKPGGSLRLSCAVSGFTFSNYKMNWVRQAPGKGLEWVSSISSRNSYIDYADSVKGRFTISRDNAKSSLYLQMNSLRTEDTAVYYCASGATLDYWGQGTLVT

SEQ ID NO: 7487 - protein, 119 aa, Artificial Sequence
  Description of Artificial Sequence: Synthetic polypeptide
EVQLVESGAEVRKPGASVKVSCKASGYTFIGYYVHWLRQAPGQGLEWMGWINPSGGGALYAPKFQGLITLTSDPFTNTAYMEMRSLKSDDTAVYFCARDGRGSASHSRFDSWGQGTLVT

SEQ ID NO: 7488 - protein, 119 aa, Artificial Sequence
  Description of Artificial Sequence: Synthetic polypeptide
QVQLVQSGTEVKKLGASVKVSCKTSGYTFTNYGLTWVRQAPGGRPEWMGWISPNNGNTNYAQKFQGRVTVSTDKSTTTVYMELRSLTSDDTAVYYCARDYFGSGSTYFLDFWGQGTLVT

SEQ ID NO: 7489 - protein, 118 aa, Artificial Sequence
  Description of Artificial Sequence: Synthetic polypeptide
QVQLVQSGGEVKKPGASVKVSCKASGYTFTRYGLTWLRQAPGQGPEWMGWISGLNGNTNYAQKFQGRVTMTTDTSTSTAYMELRSLRPDDTAVYYCARDYYSSGNYYFEHWGHGTLVT

SEQ ID NO: 7490 - protein, 124 aa, Artificial Sequence
  Description of Artificial Sequence: Synthetic polypeptide
EVQLVESGGGLVKPGGSLRLSCAGSGFTFRSYRMNWVRQAPGKGLEWVSSISSSSDYIHYADSVKGRFSISRDNGKISVYLEMNSLRPEDTAVYYCARDFESRYGQQYHYFYGLDVWGQGTTVT

SEQ ID NO: 7491 - protein, 121 aa, Artificial Sequence
  Description of Artificial Sequence: Synthetic polypeptide
QVQLVQSGGGVVQPGASLRLSCAASGFSFSTYGMHWVRQAPGKGLEWVASISYDDGAAKHYADSMKGRLTISRDNSKDTLFLQMNSLRTEDTAVYYCAKLGIGSRYYHYGTDVWGQGTTVT

SEQ ID NO: 7492 - protein, 116 aa, Artificial Sequence
  Description of Artificial Sequence: Synthetic polypeptide
QLQLQESGPGLVKPSETLSLTCTVSGASISDTTYYWGWIRQTPGKGLEWIGSIYYSGSTYYTPSLRGRVTISRDTSKNQFSLRMPSVTAADTAVYYCATLTWTAMVHYWGQGTRVT

SEQ ID NO: 7493 - protein, 114 aa, Artificial Sequence
  Description of Artificial Sequence: Synthetic polypeptide
QVQLQQWGPGLVKPSQTLSLTCTVSVGSIKNGDPYWSWIRQLPGKGLEWIGYVNSRGSTYYSPSLKSRLTLSLDTSKSQFFLQLRSMSAADTAMYYCGRGFSGFDIWGQGTMVT

SEQ ID NO: 7494 - protein, 116 aa, Artificial Sequence
  Description of Artificial Sequence: Synthetic polypeptide
QITLKESGGGVVQPGRSLRLSCAASGFGFKTYPMHWVRQAPGKGLEWVALISFDGNYEKYADSVKGRFTISRDNSKNTLYLQMNTLRAEDTAVYYCTRGPQWEHSFDLWGQGTMVT

SEQ ID NO: 7495 - protein, 125 aa, Artificial Sequence
  Description of Artificial Sequence: Synthetic polypeptide
QVQLQESGPGLVKPSETLSLTCTVSGGFISDYYWNWIRQSPGKGLEWIGNIYNRGSANSSPSLKSRVTMSVDTSKNQFSLNLSSATAADTAVYYCARTRLYDSGGFSFRQFRQGFDVWGLGTVVT

SEQ ID NO: 7496 - protein, 116 aa, Artificial Sequence
  Description of Artificial Sequence: Synthetic polypeptide
EVQLVESGGGVVQPGRSLRLSCAASGFTFSSYGMHWVRQAPGKGLEWVAVISFDGSDIYYADSVRGRFTVSRDNSKNTLSLEMNSLRGDDTAVYFCAREINWGKYLDLWGRGTLVT

SEQ ID NO: 7497 - protein, 115 aa, Artificial Sequence
  Description of Artificial Sequence: Synthetic polypeptide
QVQLQESGSELVKPSQTLFLTCAVSGGSIKSGGYSWSWIRQPPGKGLEFIGYIYENGATYYNPSLDSRLTLSVDRSKNQFSLELTSVTAADTAVYYCARGRYYYFDVWGRGTRVT

SEQ ID NO: 7498 - protein, 119 aa, Artificial Sequence
  Description of Artificial Sequence: Synthetic polypeptide
EVQLVETGGGVVQPGRSLRLSCAASGFTFSQYAMHWVRQAPGKGLEWVAIISHDERNKYYVDSGMGRFTISRDNSKNTLFLQMNSLRSEDTAVYYCARDMRKGGYYYGFDVWGQGTTVT

SEQ ID NO: 7499 - protein, 117 aa, Artificial Sequence
  Description of Artificial Sequence: Synthetic polypeptide
QVQLQESGPGLVKPSGTLSLTCTVSGANIRGSNWWGWVRQPPGKGLEWIGEVYHSGTTNINPSLKSRVTMSADTSKNQLSLKVTSVTAADTAVYYCARREVFFYYGMDVWGQGTTVT

SEQ ID NO: 7500 - protein, 123 aa, Artificial Sequence
  Description of Artificial Sequence: Synthetic polypeptide
EVQLVQSGDEVKRPGASVKVSCKASGYKFTNIGISWVRQAPGQGLEWLGWISAYNGNTNYAQRLQDRVTMTTDKSTGTAYLELRSLRSDDTAVYFCARDFPSVRFWGNDYYGMDVWGQGTTVT

SEQ ID NO: 7501 - protein, 121 aa, Artificial Sequence
  Description of Artificial Sequence: Synthetic polypeptide
EVQLVETGGGLVKPGGSLRLSCVASGFTFSDYSVNWVRQAPGKGLEWVSSISTRSHYIYYAGSVKGRFTISRDNTKNSVYLQMNSLRAEDTAVYYCARGLPRLTAAAKYGMDVWGQGTTVT

SEQ ID NO: 7502 - protein, 110 aa, Artificial Sequence
  Description of Artificial Sequence: Synthetic polypeptide
EVQLVESGGTLVKPGGSLRLSCEGSGFAFGNYHMNWVRQAPGKGLEWISFISSTSRYIYYRDSVKGRFTISRDNAKNSLYLHMNNLRVDDTAVYYCASLPGVWGQGTLVT

SEQ ID NO: 7503 - protein, 119 aa, Artificial Sequence
  Description of Artificial Sequence: Synthetic polypeptide
EVQLVETGGGLVQPGGSLRLSCAASGFSFDKYGMSWVRQAPGKGLEWVAAISGSGGVTYYGDSVKGRFTISRDNSKNTLYLQMNSLRAEDTAIYYCAKNGKQWLVANAFDIWGQGTMVT

SEQ ID NO: 7504 - protein, 117 aa, Artificial Sequence
  Description of Artificial Sequence: Synthetic polypeptide
EVQLVESGGGVVQTGKSLRLSCAASGFMFSSYGFHWVRQAPGKGLEWVAVISFDGNNQRYADSVKGRFILSKDNSKNTVFLQINSLRHEDTAVYHCARERNLGVVAFDNWGPGTLVT

SEQ ID NO: 7505 - protein, 127 aa, Artificial Sequence
  Description of Artificial Sequence: Synthetic polypeptide
QVQLQQWGAGLLKPSETLSLTCSVSGGAFSGYYWTWIRQTPGKGLEWIGEIIHSGNTDYNPSLESRVTISVDTSKNQFSLRLTSVTAADTAVYYCARGKGVFYGSGTYYKSFYYQGMDVWGQGTTVT

SEQ ID NO: 7506 - protein, 119 aa, Artificial Sequence
  Description of Artificial Sequence: Synthetic polypeptide
QITLKESGGGVVQPGRSLRLSCTGSGFRFRDYVMNWVRQAPGQGLEWVATIWHDGSRKYYTDSVKGRFFISRDNSRNALFLELNTLRGEDTAVYFCARAEDCVGGSCYLDNWGQGTLVT

SEQ ID NO: 7507 - protein, 117 aa, Artificial Sequence
  Description of Artificial Sequence: Synthetic polypeptide
EVQLVQSGAEVKKPGYSVKVSCKASGDTFTAFDFSWVRQAPGQGLEWLGKITPMTAMTDYAPRLQGRVTMTADKATRTVYMQLSNLRGEDTAVYYCARAVRGGIWGLDSWGQGTLVT

SEQ ID NO: 7508 - protein, 117 aa, Artificial Sequence
  Description of Artificial Sequence: Synthetic polypeptide
QVQLQESGPGLVKPSETLSLTCTVSGGSITSNSFYWGWIRQAPGKGLEWIGSLYYSGSTYYNPSLRSRLTISLDRSKNEFSLNLKSVTAADTAVYYCARGILFVTYFDLWGQGTQVT

SEQ ID NO: 7509 - protein, 119 aa, Artificial Sequence
  Description of Artificial Sequence: Synthetic polypeptide
EVQLVESGGGVVQPGRSLRLSCAASGFTFKDYGMHWVRQAPGKGLEWVGVISYDGTKVNYADSVKGRFTISRDNPKKTVYLQTTSLKTDDTAVYFCAKGIWDAYLYYAMDVWGQGTTVT

SEQ ID NO: 7510 - protein, 128 aa, Artificial Sequence
  Description of Artificial Sequence: Synthetic polypeptide
QVQLQESGPGLVKTSQTLSLTCTVSGGSMSGVGYYWSWVRQHPGKGLEWIGYTHSSGKTYYNTSLKSRVIISLDTSKKQFSLTLSSVTAADTAVYFCARDRRITMSRGPTYHENHDAFDIWGQGTMVT

SEQ ID NO: 7511 - protein, 119 aa, Artificial Sequence
  Description of Artificial Sequence: Synthetic polypeptide
QVQLVQSGAEVKKPGASVKVSCKASGYTFTGYYLHWVRQAPGQGLEWMGWINPGGGGTLFAEKFQGRVTVTRDASISTAYMELSGLTSDDTAVYYCARDGRGSGSHSRFDPWGQGTLVT

SEQ ID NO: 7512 - protein, 123 aa, Artificial Sequence
  Description of Artificial Sequence: Synthetic polypeptide
QVQLVQSGGTLVQPGGSLTLSCEASGFSFGIIFSKYGMDWVRQAPGKGLEWVSAISGSGSTTSYADSVKGRFTISRDNSKNTLYLQINSLRADDTAVYFCAKRRRQWLSTDSFDIWGQGTMVT

SEQ ID NO: 7513 - protein, 121 aa, Artificial Sequence
  Description of Artificial Sequence: Synthetic polypeptide
QVQLQQWGPGLVKPSETLSLTCTVSGASFFSYHWGWIRQPPGKGLEWIGHISSSGATNYNPSLKSRLTISVDTSKNQFSLKLSSVTAADTAVYYCARVRVSVYGLLVHRVFDFWGQGALVT

SEQ ID NO: 7514 - protein, 126 aa, Artificial Sequence
  Description of Artificial Sequence: Synthetic polypeptide
QVQLQESGSGLVKPSQTLSLTCAVSGGSIMTGGYSWSWIRQTPGKGLEWIGYIYHSGSTSYNPSLESRVTISVDRFKNQLSLQLTSVTAADTGVYYCARDHGGFRCSGGACFSNYFDPWGQGALVT

SEQ ID NO: 7515 - protein, 119 aa, Artificial Sequence
  Description of Artificial Sequence: Synthetic polypeptide
QVQLVQSGGGLIQPGGSLRLSCAASGFTFDKYAMSWVRQAPGKGLEWIASTSGRGTSTFYADSVKGRFTISRDNSEKMLHLQMHGLRAEDTAVYYCAKNAKQWLVTNAFDVWGQGTMVT

SEQ ID NO: 7516 - protein, 112 aa, Artificial Sequence
  Description of Artificial Sequence: Synthetic polypeptide
QVQLQESGGGLVKPGGSLRLSCAASGFTFSNFAINWVRQAPGKGPEWLSSISSTSRYIYYADSVKGRFTISRDNAKNSLFLQMNSLRAEDTAVYYCATGRTLDYWGQGTLVT

SEQ ID NO: 7517 - protein, 112 aa, Artificial Sequence
  Description of Artificial Sequence: Synthetic polypeptide
EVQLVETGGGLVQPGGSLRLSCAASGFAFSNYNMNWVRQAPGKGLEWVSSISSRNSYIYYADSVKGRFTISRDNAKNSLFLQMNSLRAEDTAVYYCATGRTLDYWGQGTLVT

SEQ ID NO: 7518 - protein, 112 aa, Artificial Sequence
  Description of Artificial Sequence: Synthetic polypeptide
EVQLVESGGGLVKPGGSLRLSCAASGFAFSNYNMNWVRQAPGKGLEWVSSISSRNSYIYYADSVKGRFTISRDNARDSLYLQLNNLRAEDTAVYYCATGVTLDYWGQGTLVT

SEQ ID NO: 7519 - protein, 119 aa, Artificial Sequence
  Description of Artificial Sequence: Synthetic polypeptide
EVQLVESGGGLVQPGGSLRLSCAASGFTFSKYGMNWVRQAPGKGLEWVSGLSGSGGNTYYADSVKGRFTVSRDNSKDTLYLQINGLRAEDTARYFCAKRKRQYVVNDAFDFWGPGTMVT

SEQ ID NO: 7520 - protein, 119 aa, Artificial Sequence
  Description of Artificial Sequence: Synthetic polypeptide
QMQLVQSGGGFVQPGGSLRLSCVASVNTLDKNGMSWVRQAPGKGLEWVSGISGSGGTTYYADSVKGRFTISRDNSENTLYLQMNSLRVEDTAVYYCAKRRRQYLASDAFDVWGQGTLVT

SEQ ID NO: 7521 - protein, 115 aa, Artificial Sequence
  Description of Artificial Sequence: Synthetic polypeptide
QVQLQQWGAGLLKPSETLSLTCAVYGGSFSGYYWSWIRQPPGKGLEWIGDINHRGSASYNSSLKSRLTISVDTSKRQFSLKLSSVTAADTAVYYCARGGWRGGILHYWGQGTLVT

SEQ ID NO: 7522 - protein, 119 aa, Artificial Sequence
  Description of Artificial Sequence: Synthetic polypeptide
QVQLVQSKAEMKRPGASVKVSCTTSGYTFTNYGLGWVRQAPGQGLEYVGWITPYNGYTNSAQNLQGRVTLTTDTSTRTAYMELRSLRSDDTAVYFCARGLRYYFTTSSFDYWGQGTLVT

SEQ ID NO: 7523 - protein, 118 aa, Artificial Sequence
  Description of Artificial Sequence: Synthetic polypeptide
QVQLVQSGAEVKKPGASVKVSCKASGYTFSRYGMTWLRQAPGQGPEWMGWISGYNGNTNYAQKVEGRVTITTDTSTSTAYMELRSLKSDDTAVYYCARDYYHSGSYYFDYWGQGTLVT

SEQ ID NO: 7524 - protein, 124 aa, Artificial Sequence
  Description of Artificial Sequence: Synthetic polypeptide
EVQLVETGAEVKKPGASVKVSCKASDYIFTKYDINWVRQAPGQGLEWMGWMSANTGNTGYAQKFQGRVTMTRDTSINTAYMELSSLTSGDTAVYFCARSSLFKTETAPYYHFALDVWGQGTTVT

SEQ ID NO: 7525 - protein, 118 aa, Artificial Sequence
  Description of Artificial Sequence: Synthetic polypeptide
QVQLVQSGAEVRKPGASVKVSCKASGFSLSDSYMHWVRQAPGQGLEWMGYINPYSGGTNFAQKFQGWVTVTRDTSINTLYMDLSRLKSDDTAVYYCAREDFSGNWRAFDIWGQGTMVT

SEQ ID NO: 7526 - protein, 129 aa, Artificial Sequence
  Description of Artificial Sequence: Synthetic polypeptide
QVQLQESGPGLVKTSGTLSLTCVVSGDSIRTNNWWSWVRQTPGRGLEWIGEIYYSGKTRYNPSLESRVTISLDTSNSQFSLKLTSVSAADTAVYYCSRVPRLVVARIRPSSPPSRDTWFDTWGQGILVT

SEQ ID NO: 7527 - protein, 119 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARKPRGYSGYRAGMDVWGQGTTVT

SEQ ID NO: 7528 - protein, 120 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGPRFRCSSTSCSFDYWGQGTLVT

SEQ ID NO: 7529 - protein, 122 aa, Artificial Sequence
  Description of Artificial Sequence: Synthetic polypeptide
QVQLQQSGAEVKKPGASVKVSCKTSGGPLSNYGISWVRQARGQGLEWMGGIVPNSGTANSAQKFQGRVTITADPSAATAYLEVRSLRDEDTAVYYCVRGNWNYRLGWPSLDYWGQETLVTVS

SEQ ID NO: 7530 - protein, 116 aa, Artificial Sequence
  Description of Artificial Sequence: Synthetic polypeptide
EVQLVESGGGVVQPGRSLRLSCSASGFTFNNYAMHWVRQAPGKGLEWVALISFDGTNRNYADSVKGRFTVSRDNSQNTLSLQMNSLRVEDTAVYYCARHFNWGKTLDYWGQGSLVT

SEQ ID NO: 7531 - protein, 126 aa, Artificial Sequence
  Description of Artificial Sequence: Synthetic polypeptide
EVQLVETGGGVVQPGRPLRLSCAASGFDFSRYAINWVRQAPGKGLEWVALISYDGLNKYYADSVKGRFAISRDNSKNTVFLQVSSLRPEDTATYYCAKASAAASLIHRVDYYYFGVDVWGQGTTVT

SEQ ID NO: 7532 - protein, 112 aa, Artificial Sequence
  Description of Artificial Sequence: Synthetic polypeptide
EVQLVETGGGLVKPGGSLRVSCTVSGFTFSNYNMNWVRQAPGKGLEWVSSISSTSAYIYYADSVRGRFTISRDNAKNSLYLQMNSLRADDTAVYYCASGRTFDYWGQGTLVT

SEQ ID NO: 7533 - protein, 119 aa, Artificial Sequence
  Description of Artificial Sequence: Synthetic polypeptide
EVQLVESGGGLVQPGGSLRLSCAASGFTFHSYGMRWVRQAPGKGLEWVSAISGRGTTTDYADSVKGRFTISRDNSKNTLYLQMNSLRAEDTAVYYCAKAHKQWLVSNALDYWGQGTLVT

SEQ ID NO: 7534 - protein, 112 aa, Artificial Sequence
  Description of Artificial Sequence: Synthetic polypeptide
EVQLVESGGGLVKPGGSLSLSCAVSGFSISNYWMNWVRQAPGKGLEWVSSISSTSTTIYYAASVKGRFTVSRDNGRNVVSLQMSSLRVEDTAVYFCTSGRSFDYWGQGTLVT

SEQ ID NO: 7535 - protein, 150 aa, Artificial Sequence
  Description of Artificial Sequence: Synthetic polypeptide
EFMDMEVLVQLLFLLLLWLPDITGEFVLTQSPGTLSLSPGDRATLSCRASQSVDNYYLGWYQQKPGQAPRLLIFGASSRATGIPDRFSGSGSGTDFTLTISRLEPEDFAIYYCQHYGSSPPWTFGQGTKVEMKRTVAAPSVFIFPPSDEA

SEQ ID NO: 7536 - protein, 123 aa, Artificial Sequence
  Description of Artificial Sequence: Synthetic polypeptide
QVQLVESGGGVVQPGRSLRLSCAGSGFIFSSYAMNWVRQTPVKGLEWVAVISYDGSNKYYADSVKGRFTISRDNSKNTLYLQMNSLGGEDTAVYFCARGRVHSSSWPTPSDLWGQGTLVTVSS

SEQ ID NO: 7537 - protein, 127 aa, Artificial Sequence
  Description of Artificial Sequence: Synthetic polypeptide
QVQLVESGGGVVQPGRSLRVSCEASGLNFSNHGMHWVRQAPGKGLEWLAIISYDGTNKFYADSVKGRFTISRDNSRNTVFLEMNSLRAEDTAVYYCAKDVWWPRPSRDSYYSAMDVWGQGTTVTVSS

SEQ ID NO: 7538 - protein, 127 aa, Artificial Sequence
  Description of Artificial Sequence: Synthetic polypeptide
QVQLLESGGGLVKPGGSLRLSCAASGFTFTDYYMTWIRQAPGKGLEWVSCVGSSGTYTNYADSVKGRFTISRDNAKNSLYLQMNSLRTEDTAVYYCARVTGSGNFYGSYHYYYMDVWGKGTTVTVSS

SEQ ID NO: 7539 - protein, 125 aa, Artificial Sequence
  Description of Artificial Sequence: Synthetic polypeptide
QVQLQESGPGLVKPSETLSLTCTVSGDSIGSYYWSWIRQTPAKGLEWIGNIFYTGTINYNPSLKSRVTISVDTFKNQFSLTLTSVTAADTAVYYCAREGEFFDILTGDYRGLDYWGQGTLVTVSS

SEQ ID NO: 7540 - protein, 125 aa, Artificial Sequence
  Description of Artificial Sequence: Synthetic polypeptide
EVQLVESGGDLVQPGGSLRLSCEASGFTFSNYAMSWVRQAPGKGLEWVSGTSGSGGSTYYADSVKGRFTLSRDNSKNTLYLQMNSLRAEDTAVYYCAKDREVLRFFLLPYYFDSWGQGTLVTVSS

SEQ ID NO: 7541 - protein, 122 aa, Artificial Sequence
  Description of Artificial Sequence: Synthetic polypeptide
QVQLVESGAEVKKPGASVKVSCKTSGYTFSSYGITWVRQAPGQGLEWMGWISAYNGDTNYAQNVQGRVTMTTDTSTSTAYMELRSLRFDDTAVYYCARDTSFAPSGYGFDISGQGTTVTVSS

SEQ ID NO: 7542 - protein, 123 aa, Artificial Sequence
  Description of Artificial Sequence: Synthetic polypeptide
QVQLVESGPGLVKPSETLSLTCTVSGASVSSGTYYWSWIRQPPGKGLEWIGYSYYTGSSDSNASLKSRVTLSIDSRNLLSLKLSVTAADTAVYYCARDRRKVRGVWAGYSGMDVWGPGVTVSS

SEQ ID NO: 7543 - protein, 120 aa, Artificial Sequence
  Description of Artificial Sequence: Synthetic polypeptide
QITLRESGAEVTKPGSSVKVSCKASGGTFGSYGIRWVRQAPGQGLEWMGGIIPMFGTANYAQRFQGRVTITADKSTSTAYMELSSLKSEDTAVYYCARENSIVGAWFDPWGQGTLVTVSS

SEQ ID NO: 7544 - protein, 117 aa, Artificial Sequence
  Description of Artificial Sequence: Synthetic polypeptide
EVQLVESGGGVVQPGGSLRLSCAASGFTFSSFDMHWVRQAPGKGLQWVAFIRHHGTNHSYVDSVKGRFTISRDNSRNTLYLQMNSLRPEDTALYYCAKDLGFGELYWGQGTLVTVSS

SEQ ID NO: 7545 - protein, 102 aa, Artificial Sequence
  Description of Artificial Sequence: Synthetic polypeptide
DIQLTQSPSFLSASVGDRVTITCWASQDISSYLAWYQQRPGEAPELLIYAASTLQSGVPSRFSGGGSGDFLISSLQPEDFAYYCQQLKSYPPTFGGGKVEIK

SEQ ID NO: 7546 - protein, 105 aa, Artificial Sequence
  Description of Artificial Sequence: Synthetic polypeptide
EIVLTQSPGTLSLFPGERATLSCRASQSVSSNYLAWYQQKPGQAPRLLIYGASSRATGIPDRFSGSGSGTDFTLTISRLEPEDFAVYYCQLFGSPFGQGTKVEIK

SEQ ID NO: 7547 - protein, 103 aa, Artificial Sequence
  Description of Artificial Sequence: Synthetic polypeptide
EIVLTQSPATLSLSPGKKATLSCRASQSVSNYLAWYQQKPGQSPRLLIFDASKRAAGIPARFSGSGSGDFTLISSLEPEDFAVYYCQQRTWLTFGGGTKVEIK

SEQ ID NO: 7548 - protein, 108 aa, Artificial Sequence
  Description of Artificial Sequence: Synthetic polypeptide
EIVLTQSPGTLSLSPGERATLSCRASQSVSSTYLAWFQQRPGQAPRLLIYGTSSRATGIPDRFSGGGSGTDFTLTISRLEPEDFAVYFCQQYGTSPWTFGQGTKVEIK

SEQ ID NO: 7549 - protein, 105 aa, Artificial Sequence
  Description of Artificial Sequence: Synthetic polypeptide
EIVLTQSPGSLSLSPGERATLSCRASQSVSSDYVAWYQQKPGQAPRLLIFDASTRATGIPDRFSGSGSGDFTLIGRLEPEDFAVYYCQQYGSPLTFGGGAKVEIK

SEQ ID NO: 7550 - protein, 106 aa, Artificial Sequence
  Description of Artificial Sequence: Synthetic polypeptide
DIQLTQSPSSLSASVGDRVTITCRASQGIRHELAWYQQKPGKAPQRLIYAASSLQSGVPSRFSGSGSGTDFTLTINSLQPEDSATYYCLQVSYPRTFGQGTRVDIK

SEQ ID NO: 7551 - protein, 110 aa, Artificial Sequence
  Description of Artificial Sequence: Synthetic polypeptide
EIVMTQSPSSLSASVGDRVTITCQASQEITNYLNWYQQKPGKAPKLLIYDASHLETGVPSRFSGSGSGTDFSFTISSLQPEDIATYYCQQYDDFPWGGVTFGGGTKVEIK

SEQ ID NO: 7552 - protein, 101 aa, Artificial Sequence
  Description of Artificial Sequence: Synthetic polypeptide
EIVMTQSPSSLSASVGDRVTFTCRASQSISTYLNWYQQKPGKAPTLLIYAASTLRSGVPSRFSGSGSGDFLISSLQPVDFAYFCQQSYSSPYTFGQGLEIK

SEQ ID NO: 7553 - protein, 108 aa, Artificial Sequence
  Description of Artificial Sequence: Synthetic polypeptide
DIVMTQSPATLSVSPGDRATLSCRASQSVRTNLAWYQQKPGQAPRLLIHDGFTRSAGIPARFSGSGSGTEFTLTISSLQSEDFAVYYCQQYRTWPRVTFGPGTKVDIK

SEQ ID NO: 7554 - protein, 283 aa, Artificial Sequence
  Description of Artificial Sequence: Synthetic polypeptide
MTQSPASLAVSLGQRATISCRASKSVSTSGYSYMHWYQQKPGQPPKLLIYLASNLESGVPARFSGSGSGTDFTLNIHPVEEEDAATYYCQHSRELPLTFGAGTKLEIKSSGGGGSGGGGGGSSRSSFEVQLQQSGPELVKPGTSVKISCKTSGYTFTEYTIHWVKQSQGKSLEWIGGINPKNGGTRYNQKFKDKATLTVDKSSSTAYMELRSLTSEDSEVYYCARRVYDEYPYYYALDYWGQGTSVTVSSAKTTPPSVTSGQAGQHHHHHHGAYPYDVPDYAS

SEQ ID NO: 7555 - protein, 213 aa, Artificial Sequence
  Description of Artificial Sequence: Synthetic polypeptide
DFTLNIHPVEEEDAATYYCQHSRELPLTFGAGTKLEIKSSGGGGSGGGGGGSSRSSLEVQLQQSGPELVKPGASVKISCKTSGYTFTEYTIHWVKQSHGKSLEWIGGINPKNGGTRYNQKFKDKATLTVDKSSSTAYMELRSLTSEDSEVYYCARRVYDEYPYYYALDYWGQGTSVTVSSAKTTAPSVTSGQAGQHHHHHHGAYPYDVPDYAS

SEQ ID NO: 7556 - protein, 283 aa, Artificial Sequence
  Description of Artificial Sequence: Synthetic polypeptide
MTQSPASLAVSLGQRATISCRASKSVSTSGYSYMHWYQQKPGQPPKLLIYLASNLESGVPARFSGSGSGTDFTLNIHPVEEEDAATYYCQHSRELPLTFGAGTKLEIKSSGGGGSGGGGGGSSRSSLEVQLQQSGPELVKPGASVKISCKTSGYTFTEYTMHWVKQSHGKSLEWVGGINPKNGGITYNQKFQGKATLTVDKSSSTASMELRSLTSDDSAVYYCARRVYDDYPYYYAMDYWGQGTSVTVSSAKTTAPSVTSGQAGQHHHHHHGAYPYDVPDYAS

SEQ ID NO: 7557 - protein, 258 aa, Artificial Sequence
  Description of Artificial Sequence: Synthetic polypeptide
LLNSGNQKNYLTWYQQKPGQPPKLLIYWASTRESGVPDRFTGRGSGTDFTLTISSVQAEDLAVYFCQNDFIYPFTFGGGTKLEIKSSGGGGSGGGGGGSSRSSLEVQLQQSGAELVRPGTSVKISCKASGYTFTNFWLGWVKQRPGHGLEWIGNIYPGRDYTNFNEKFKGKATLTADTSSSTAYMQLSGLTSEDSAVYFCAREGLRVPYYAMDYWGQGTSVTVSSAKTTAPSVTSGQAGQHHHHHHGAYPYDVPDYAS

SEQ ID NO: 7558 - protein, 283 aa, Artificial Sequence
  Description of Artificial Sequence: Synthetic polypeptide
MTQAPASLAVSLGQRATISCRASKSVSSSGYNYLHWYQQKPGQPPKLLIYLASNLESGVPARFSGSGSGTDFTLNIHPVEEEDAATYYCQHSREFPLTFGAGTKLEIKSSGGGGSGGGGGGSSRSSLEVQLQQSGPELVKPGASVKISCKTSGYTFTGYTMHWVRQSHGKSLEWIGGINPKNGGIIYNQKFQGKATLTVDKSSSTASMELRSLTSDDSAVYYCARRVYDDYPYYYAMDYWGQGTSVTVSSAKTTPPSVTSGQAGQHHHHHHGAYPYDVPDYAS

SEQ ID NO: 7559 - protein, 348 aa, Artificial Sequence
  Description of Artificial Sequence: Synthetic polypeptide
MTQTHKFMSTSVGDRVSITCKASQDVGTAVAWYQQKPGQSPKLLIYWASTRHTGVPDRFTGSGSGTDFTFTISNVQSEDLADYFCQQYSAILYTFGGGTKLEIKSSGGGGSGGGGGGSSRSSFEVQLQQSGAELMKPGASVKISCKATGHTFSSFWIEWVKQRPGQGLEWIGEILPGRSTSNYNEKFKGKATITADTSSDTAYMQLSSLTSEDSAVYYCARKDLYYGYDPHFDYWGQGTTLTVSSAKTTAPSVTSGQAGQHHHHHHGAYPYDVPDYASMTQSPASLAVSLGQRATISCRASKSVSTSGYSYMHWYQQKPGQPPKLLIYLASNLESGVPARFSGSGSGT

SEQ ID NO: 7560 - protein, 278 aa, Artificial Sequence
  Description of Artificial Sequence: Synthetic polypeptide
MTQELHSPHHLVEQSYSCRSSTGAVTTSNYANWVQEKPDHLFTGLIGGTSNRAPGVPVRFSGSLIGDKAALTITGAQTEDDAMYFCALWYSTHWVLGGGTKLLSSSSGGGGSGGGGGGSSRSSLEVKLMESGAELIRPGTSVKISCKTSGYTFTDFWLGWAKQRPGHGLEWIGNIYPGRDYTNFNEKFKGRAILTADTSFTTAYMQLSGLTSEDSAVYFCAREGLRVPYFAMDYWGQGTSVTVSSAKTTAPSVTSGQAGQHHHHHHGAYPYDVPDYAS

SEQ ID NO: 7561 - protein, 303 aa, Artificial Sequence
  Description of Artificial Sequence: Synthetic polypeptide
MKYLLPTAAAGLLLLAAQPAMADYKDQSALTQPASVSGNPGQTVTISCAGTSSDIGGYNHVAWYQQFPGSAPKTLIYSVDKRPSGIPARFSGSKSGNTATLTISGLQAEDEADYYCGSYKRGGTALFGSGTRLTVLGQPKSAPSGGGGSGGGGSGGGGSGGGGSQVRLQESGPSLVKPSQTLSLTCTVSGFSATSYAVGWVRQAPGKALEWVGSIWAGGSKHYNPALKSRLSITRDTSKSQVSLLLSSVTTEDTAVYYCARGGSDIDAWGPGLLVSVSSASTTAPKVASGAEFEQKLISEEDL

SEQ ID NO: 7562 - protein, 283 aa, Artificial Sequence
  Description of Artificial Sequence: Synthetic polypeptide
MKYLLPTAAAGLLLLAAQPAMADYKDVVLTQTPLSLSVIPGETASISCKSSQSLVHSNGKTYLYWIQHKPGQSPKGLIYRISNRYAGVSDRFTGSGSGTDFTLQISSVQAEDAGVYYCVQGTEVPHTFGQGTKLEIKGGGGSGGGGSQVRLQESGPSLVKPSQTLSLTCTVSGFSLSNYDITWVRQAPGKALEWVGNVYRGGNTHYNPALKSRLSITRDTSKSQVSLSLSSVTTEDTAVYYCVRRFDVWGRGLLVTVSSASTTAPKVASGAEFEQKLISEEDL

SEQ ID NO: 7563 - protein, 330 aa, Artificial Sequence
  Description of Artificial Sequence: Synthetic polypeptide
AKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 7564 - protein, 330 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 7565 - protein, 377 aa, Artificial Sequence
  Description of Artificial Sequence: Synthetic polypeptide
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPYPRCPEPKSCDTPPPCPRCPEPKSCDTPPPCPRCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 7566 - protein, 330 aa, Artificial Sequence [sequence omitted]

SEQ ID NO: 7567 - protein, 377 aa, Artificial Sequence
  Description of Artificial Sequence: Synthetic polypeptide
ASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPLGDTTHTCPRCPEPKSCDTPPPYPRCPEPKSCDTPPPCPRCPEPKSCDTPPPCPRCPAPELLGGPSVFLFPPKPKDTLMISRTPEVTCVVVDVSHEDPEVQFKWYVDGVEVHNAKTKPREEQFNSTFRVVSVLTVLHQDWLNGKEYKCKVSNKALPAPIEKTISKTKGQPREPQVYTLPPSREEMTKNQVSLTCLVKGFYPSDIAVEWESSGQPENNYNTTPPMLDSDGSFFLYSKLTVDKSRWQQGNIFSCSVMHEALHNRFTQKSLSLSPGK

SEQ ID NO: 7568 - protein, 117 aa, Artificial Sequence
  Description of Artificial Sequence: Synthetic polypeptide
QVQLVESGGGLVQPGGSLRLSCAASGFTFSNYAMSWVRQAPRRGLEWVSTIGTTDGDIHYADSVKGRFTISRDNAKNTLYLQMSSLRAEDTAVYFCALRFGEHFDYWGQGTLVTVSS

SEQ ID NO: 7569 - protein, 113 aa, Artificial Sequence
  Description of Artificial Sequence: Synthetic polypeptide
DIVMTHTPLSSPVTLGQPASISCRSSQSLVHSDGNTYLSWLQQRPGQPPRLLIYKISNRFSGVPDRFSGSGAGTDFTLKISRVEAEDVGVYYCMQATQFPWTFGQGTKVEIKR

SEQ ID NO: 7570 - protein, 105 aa, Artificial Sequence
  Description of Artificial Sequence: Synthetic polypeptide
EESGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNNSP

SEQ ID NO: 7571 - protein, 106 aa, Artificial Sequence; identical to SEQ ID NO: 4628
  Description of Artificial Sequence: Synthetic polypeptide

SEQ ID NO: 7572 - protein, 106 aa, Artificial Sequence
  Description of Artificial Sequence: Synthetic polypeptide
ADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7573 - protein, 108 aa, Artificial Sequence
  Description of Artificial Sequence: Synthetic polypeptide
TQSPAIMSASLGEKVTMTCRASSSVNYMYWYQQKSDASPKLWIYYTSNLAPGVPVRFSGSGSGNSYSLTISSMEGEDAATYYCQQFTSSPYTFGGGTKLEIKRADAAP

SEQ ID NO: 7574 - protein, 16 aa, Artificial Sequence
  Description of Artificial Sequence: Synthetic peptide
KASGYSFTVYYIYWVK

SEQ ID NO: 7575 - protein, 14 aa, Artificial Sequence
  Description of Artificial Sequence: Synthetic peptide
TRWGLRRGFAYWGQ

SEQ ID NO: 7576 - protein, 260 aa, Artificial Sequence
  Description of Artificial Sequence: Synthetic polypeptide
AQVKLQQSGAELVRPGASVKLSCKASGYSFTVYYIYWVKQRPGQALEWIGEINPSNGGTNFNEKFKTKATLTVDKSTSTVYMQLSSLTSEDSAVYYCTRWGLRRGFAYWGQGTTVTVSSSGGGSGGGGSGGGGSDIELTQSPKSMSMSVGERVTLSCKASENVGTHVSWYQQRPEESPKLLIYGASNRYTGVPDRFTGSGSATDFTLTISNVQAEDLADYHCGQTYSYPFTFGLGTKLEIKRAAAGAPVPYPDPLEPRAA

SEQ ID NO: 7577 - protein, 213 aa, Artificial Sequence
  Description of Artificial Sequence: Synthetic polypeptide
QVQLQQPGSVLVRPGASVKLSCKASGYTFTSSWMHWAKQRPGQGLEWIGEIHPNSGNTNYNEKFKGKATLTVDTSSSTAYVDLSSLTSEDSAVYYCVRGFAYWGQGTLVTVSAAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPR

SEQ ID NO: 7578 - protein, 212 aa, Artificial Sequence
  Description of Artificial Sequence: Synthetic polypeptide
  MOD_RES (79)..(79): Any amino acid
EVQLQESGPSLVKPSQTLSLTCSVTGDSITSGYWNWIRKFPGNRLEYMGYINYSGNTFYNPSLKSRISITRDTSKNQYXLQLNSVTTEDTATYYCATYRFNYWGQGTLVTVSAAKTTPPSVYPLAPGCGDTTGSSVTLGCLVKGYFPEPVTVTWNSGSLSSGVHTFPALLQSGLYTMSSSVTVPSSTWPSQTVTCSVAHPASSTTVDKKLEP

SEQ ID NO: 7579 - protein, 222 aa, Artificial Sequence
  Description of Artificial Sequence: Synthetic polypeptide
EVQLLESGPELVRLGASVKVSCKASGYSFTDYNMYWVKQSHGKSLEWIGYIDPYNGDASYNQKFKGKATLTVDKSSSTAFMHLNSLTSEDSAVYYCARTGYYYGRSYAMDYWGQGTSVTVSSAKTAAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPR

SEQ ID NO: 7580 - protein, 220 aa, Artificial Sequence
  Description of Artificial Sequence: Synthetic polypeptide
EVKLLESGGGLVQPGGSMKLSCVASGFTFSIFWMNWVRQSPEKGLEWVAEVRLKSNNYATHYAESVKGRFTISRDDSKSGVYLQMNNLRAEDTGIYYCTRGYYGSNYGEYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEP

SEQ ID NO: 7581 - protein, 213 aa, Artificial Sequence
  Description of Artificial Sequence: Synthetic polypeptide
  MOD_RES (1)..(1): Any amino acid
XVQLQQSGAELARPGASVKLSCKASGYTFTSYWMQWVKQRPGQGLEWIGAIYPGDGDTRYTQKFKGKATLTADKSSSTAYMQLSSLASEDSAVYYCARRWDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPR

SEQ ID NO: 7582 - protein, 213 aa, Artificial Sequence; identical to SEQ ID NO: 7577
  Description of Artificial Sequence: Synthetic polypeptide

SEQ ID NO: 7583 - protein, 212 aa, Artificial Sequence; identical to SEQ ID NO: 7578
  Description of Artificial Sequence: Synthetic polypeptide
  MOD_RES (79)..(79): Any amino acid

SEQ ID NO: 7584 - protein, 213 aa, Artificial Sequence; identical to SEQ ID NO: 7581
  Description of Artificial Sequence: Synthetic polypeptide
  MOD_RES (1)..(1): Any amino acid

SEQ ID NO: 7585 - protein, 217 aa, Artificial Sequence
  Description of Artificial Sequence: Synthetic polypeptide
DIVMTQSPSSLAMSVGQKVTMSCKSSQSLLNSSNQKNYLAWYQQKPGQSPKLLVYFASTRESGVPDRFIGSGSGTDFTLTISSVQAEDLADYFCQQHYSTPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNR

SEQ ID NO: 7586 - protein, 210 aa, Artificial Sequence
  Description of Artificial Sequence: Synthetic polypeptide
  MOD_RES (1)..(1): Any amino acid
XIVLTQSPAIMSASLGEEITLTCSASSSVNYMHWYQQKSGTSPKLLIYTTSNLASGVPSRFSGSGSGTFYSLTISSVEAEDAADYYCHQWSSYPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRN

SEQ ID NO: 7587 - protein, 219 aa, Artificial Sequence
  Description of Artificial Sequence: Synthetic polypeptide
DIVMTQAAPSVPVTPGESVSISCRSSKSLLHSNGNTYLYWFLQRPGQSPQLLIYRMSNLASGVPDRFSGSGSGTAFTLRISKVEAEDVGVYYCMQHLEYPYTFGGGTKLDVKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 7588 - protein, 216 aa, Artificial Sequence
  Description of Artificial Sequence: Synthetic polypeptide
DVVMTQSPSSLSVTIGQPASISCKSSQSLLDSDGGTYLNWLLQRPGQSPKRLIYLVSKLDSGVPDRFTGSGSGTDFTLKISRVEAEDLGIYYCWQGAHFPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNR

SEQ ID NO: 7589 - protein, 219 aa, Artificial Sequence
  Description of Artificial Sequence: Synthetic polypeptide
QIVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNE

SEQ ID NO: 7590 - protein, 217 aa, Artificial Sequence; identical to SEQ ID NO: 7585
  Description of Artificial Sequence: Synthetic polypeptide

SEQ ID NO: 7591 - protein, 210 aa, Artificial Sequence; identical to SEQ ID NO: 7586
  Description of Artificial Sequence: Synthetic polypeptide
  MOD_RES (1)..(1): Any amino acid

SEQ ID NO: 7592 - protein, 219 aa, Artificial Sequence; identical to SEQ ID NO: 7589
  Description of Artificial Sequence: Synthetic polypeptide

SEQ ID NO: 7593 - protein, 126 aa, Artificial Sequence
  Description of Artificial Sequence: Synthetic polypeptide
EVQLVESGPGLVKPSETLSLTCTVSGGSVSSGSYSWSWIRQRPGQGLEWIGFIYYTGYTSYKSSLKSRVSLSVDTSNDQFSLSLSSVTAADTAVYYCAREIRAPDHHDFSGYLGRWGQGTLVTVSS

SEQ ID NO: 7594 - protein, 116 aa, Artificial Sequence
  Description of Artificial Sequence: Synthetic polypeptide
EVKLVESGGGLVQPGGSLKLSCATSGFLFTDYYMFWVRQTPEKRLEWVAYISNGGGDTYYPDTVKGRFTISRDNAKNALYLQMSRLKSEDTAMYYCARHKGYYGYYYALDYWGQGT

SEQ ID NO: 7595 - protein, 138 aa, Artificial Sequence
  Description of Artificial Sequence: Synthetic polypeptide
QVHLVQSGAEVKKPGASVKVSCRVSGNSLTESSLHWVDRPLGKGLEWMGGFDPEEGEIIYAQKFQGRVTMTEDTPTDTASLELSRVRSEDTAVYYCVTGPPRLSELAIFGVVKRIRGPFDIWGQGTRVTVSSASTKGP

SEQ ID NO: 7596 - protein, 136 aa, Artificial Sequence
  Description of Artificial Sequence: Synthetic polypeptide
RVQLMQSGAEVRKHGASVKVSCKASGYSFGNYFMHWLRQAPGQGPEWMGMINPRDNKANYAQKFRGRVTMTKDTSTSIFYMELSRLRSDDTAVYFCARDMGSHDFWAVGLNLPGSLFDNWGQGTLVTVSSASTKGP

SEQ ID NO: 7597 - protein, 247 aa, Artificial Sequence
  Description of Artificial Sequence: Synthetic polypeptide
EVQLVETGGGLVQPGESLRLSCAASGFTFSDYEMNWVRQAPGKGLEWVSYISSSGSTIYYADSVKGRFTIYRDNAKNSLYLQMNSLRAEDTALYYCARAWGVGPPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCAAAHHHHHHGAAEQKLISEEDLNGAA

SEQ ID NO: 7598 - protein, 108 aa, Artificial Sequence
  Description of Artificial Sequence: Synthetic polypeptide
DIQMTQSPSSLSASVGDRVTITCRASQGIRNDLTWYQQKPGTAPKRLIYGATSLQSGVPSRFSGSGSGTEFTLTINSLQPEDFATYYCLQYSSFPWTFGQGTKVEVKR

SEQ ID NO: 7599 - protein, 114 aa, Artificial Sequence
  Description of Artificial Sequence: Synthetic polypeptide
QVQLVDSGGGLVEPGGSLRLSCSASGFTFSANDMNWVRQAPGKGLEWLSFIGGSGSTIYYADSVKGRFTISRNBSKNSLYLQMSSLRAEDTAVYYCARGWLLNWGQGTLVTVSS

SEQ ID NO: 7600 - protein, 108 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTITGAQAEDEADYYCNSRDSTGNQLFGGGTKVTVLG

SEQ ID NO: 7601 - protein, 103 aa, Artificial Sequence
  Description of Artificial Sequence: Synthetic polypeptide
DIQLTQSPATLSVTPGDSVSLSCRASQSISNNLHWYQQKSHESPRLLIKYASQSISGIPSRFSGSGSGTDFTLSINSVETEDFGMYFCQQSNNWPLTFGAGTK

SEQ ID NO: 7602 - protein, 212 aa, Artificial Sequence
  Description of Artificial Sequence: Synthetic polypeptide
QSVLTQPPSVSVAPGKTARIPCEGNYIGSSNVHWYQQKPGQAPVLVIHFDSDRPSGIPDRFSGSNSGNMATLTISRVEAGDEADYYCQVWENHGWVFGGGTKLTVLSQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 7603 - protein, 250 aa, Artificial Sequence
  Description of Artificial Sequence: Synthetic polypeptide
MAQVQLLESGGGLIQPGGSLRLSCADSGFPVSSNFMSWVRQAPAEGLEWVSIIYPDGRTFYTESVRGRFTISRDSSKNTVYLQMNSLRAEDTAVYYCATAFSPPTQTSGWGRSSDSWGQGTLVTVSSGGGGSGGGGSGGGGSDVVMTQSPGTLSLSPGERATLSCRASQSVSSNLAWYQQRLGQAPRLLIYGASNRATGVPDRFSGSGSGTDFTLTISSLEPEDFAVYYCQQRSNWPWTFGQGTKLEIKR

SEQ ID NO: 7604 - protein, 227 aa, Artificial Sequence
  Description of Artificial Sequence: Synthetic polypeptide
MAQVQLQESGQITGAVQQGAGIDDFVMLGGQIQALFQGDGLDTFRMEGGTIVDAFEDGDVAYQSGGTIGRVNMKLDKNLYDMSGGAILGTLVTVSSGGGGSGGGGSSGGGSDVVMTQSPATLSVSPGEGVTLSCRASHSVSLGVSANLAWYQQKPGQAPRLLIYGVSNRATGVPARFSGSGSGTDFTLTISRLEPEDIAVYYCQQRSHWPWTFGQGTKVEIKRGLGG

SEQ ID NO: 7605 - protein, 251 aa, Artificial Sequence
  Description of Artificial Sequence: Synthetic polypeptide
MAQVQLVQSGAEVKKPGSSVKVSCKASGGTFSSYAISWVRQAPGQGLEWMGGIIPIFGTANYAQKFQGRVTITADESASTAYMELSSLRSEDTAVYYCVSDGSRKSLIIETFYALDVWGQGTLVTVSSGGGGSGGGGSGGGGSDVVMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKR

SEQ ID NO: 7606 - protein, 222 aa, Artificial Sequence
  Description of Artificial Sequence: Synthetic polypeptide
MAQVQLQESGQITGAVQQGAGIDDFVMLGGQIQALFQGDGLDTFRMEGGTIVNAFEDGDVAYQSGGTIGRVNMKLDKNLYDMSGGAILGTMVTVSLGGGGSGGGGSSGGGSEIVLTQSPGTLSLSPGERVTLSCRASQSVSSKLAWYQQKPGQAPRLLIYDASNRATGIPARFSGSGSGTDFTLTISSLEPEDFAVYYCQQRSNWPWTFGQGTKLEIKRGLG

SEQ ID NO: 7607 - protein, 254 aa, Artificial Sequence
  Description of Artificial Sequence: Synthetic polypeptide
MAQVQLVQSGAEVKKPGSSVKVSCKASGGTFSSYAISWVRQAPGQGLEWMGGIIPIFGTASYAQKFQGRVTITADESTSTAYMELSSLRSDDTAVYYCAGELTFGGVIVIPESAFDIWGQGTMVTVSSGGGGSGGGGSGGGGSQSALTQPASVSGSPGQSITISCTGIRSDIGGYYYVSWYQQHPGKAPKLIIYPVNSRPSGVSNRFSGSVSGDTASLTISGLQAEDEADYYCSSYTSGTTLLFGGGTQLTVLG

SEQ ID NO: 7608 - protein, 243 aa, Artificial Sequence
  Description of Artificial Sequence: Synthetic polypeptide
MDVKLQESGPGLVAPSQSLSITCTVSGFSLTGYSVNWVRQPPGKGLEWLGIIWGDGTTEYNSSLKSRLSISKDNSKSQVFLKMTSLQTDDTANYYCARDRGITRFLYWGQGTLVTVSAGGGGSGGGGSGGGGSQAVVTQESALTTSPGETVTLTCRSSTGAVTTTNYANWVQEKPDHFFTGLIGGTNNRPPGVPPRFSGSLIGDKAALTITGAQTEDEAIYFCALWYSHRWVFGGGTKLTVLG

SEQ ID NO: 7609 - protein, 243 aa, Artificial Sequence
  Description of Artificial Sequence: Synthetic polypeptide
MEVQLQQSGAELVRPGTSVKVSCKASGYAFTNYLIEWVKQRPGQGLEWIGVISPGGGSTNYNEKFKGKATLTADKSSSTAYMQLSSLTSDDSAVYFCARLWFYEVDYWGQGTSVTVSAGGGGSGGGGSGGGGSQAVVTQESALTTSPGETVTLTCRSSTGAVTTSNYANWVQEKPDHLFTGLIDGTNNRAPGVPARFSGSLIGDKAALTITGAQTEDEAIYFCALLYSNHWVFGGGTKLTVLG

SEQ ID NO: 7610 - protein, 246 aa, Artificial Sequence
  Description of Artificial Sequence: Synthetic polypeptide
MAQVKLQESGGGSVQPGGSMKLSCAASGFTFSDAWMGWVRQSPEKGLEWVAEIRSKANNHATYYAESVKGRFTISRDDSKSSVYLQMNSLRAEDTGIYYCTRAGGAMDYWGQGTTVTVSSGGGGSGGGGSGGGGSDIELTQSPASLAVSLGQRATISYRASKSVSTSGYSYMHWNQQKPGQPPRLLIYLVSNLESGVPARFSGSGSGTDFTLNIHPVEEEDAATYYCQHIREAYTFGGGTKLEIKR

SEQ ID NO: 7611 - protein, 246 aa, Artificial Sequence
  Description of Artificial Sequence: Synthetic polypeptide
MAQVKLQQSGGGLVQPGGSMKLSCAASGFTFSDAWMDWVRQSPEKGLEWVAEIRDKANNHATYYAESVKGRFTISRDDSKSSVYLQMNSLRAEDTGIYYCTRAGGAMDYWGQGTTVTVSSGGGGSGGGGSGGGGSDIELTQSPASLAVSLGQRATISYRASKSVSTSGYSYMHWNQQKPGQPPRLLIYLVSNLESGVPARFSGSGSGTDFTLNIHPVEEEDAATYYCQHIREAYTFGGGTKLEIKR

SEQ ID NO: 7612 - protein, 236 aa, Artificial Sequence
  Description of Artificial Sequence: Synthetic polypeptide
MAQVQLQESGAELVKPGASVKMSCKASGYTFTSYWLHWVKQRPGQGLEWIGTIDPSDSSTTYNQKFKGKATLTVDTSSRIAYMQLGSLTSEDSAVYYCTRTDYWGQGTTVTVSSGGGGSGGGGSGGGGSDIVLTQSPAIMSASPGEKVTMTCSASSSVSYMHWFQQRSSTPPKVWIYDTSKLASGVPGRFSGSGSGNSYSLTISSMEAEDVATYYCFQGSGFPLTFGSGTKLEIKR

SEQ ID NO: 7613 - protein, 246 aa, Artificial Sequence
  Description of Artificial Sequence: Synthetic polypeptide
MAQVQLQESGGGLVQPGGSMKLSCAASGFTFSDAWMDWVRQSPEKGLEWVAEIRNKAYNHATYYAESVKGRFTISRDDSKSGVYLQMNSLRAEDTGIYYCTGRLGAMDYWGQGTTVTVSSGGGGSGGGGSGGGGSDIELTQSPASLAVSLGQRATISYRASKSVSTSGYSYMHWNQQKPGQPPRLLIYLVSNLESGVPARFSGSGSGTDFTLNIHPVEEEDAATYYCQHIREAYTFGGGTKLEIKR

SEQ ID NO: 7614 - protein, 244 aa, Artificial Sequence
  Description of Artificial Sequence: Synthetic polypeptide
MAQVQLQESGAEVKKPGASVKVSCKASGYTFTDYYMHWVRQAPGQGLEWMGGIIPIFGTANYAQKFQGRVTITADESTSTAYMELSSLRSEDTAVYYCARDSGSYQGAFDYWGQGTLVTVSSGGGGSGGGGSGGGGSSYVLTQPPSVSVSPGQTASITCSEDTLGNKYASWYQQKPGQSPVVVIYNDNMRPSGIPERFSGSNSGNTATLTIRGTQAMDEADYYCQAWDSSGVVFGGGTKLTVLG

SEQ ID NO: 7615 - protein, 250 aa, Artificial Sequence
  Description of Artificial Sequence: Synthetic polypeptide
MAQVQLLESGGGLVRPGGSLRLSCADSGFPVSNYFMSWVRQAPAGGLEWVSIIYPDGRTFYAESVRGRFTISRDSSKNTVYLQMNRLRGEDTAVYYCARSLMPNNADDWGQGTLVTVSSGGGGSGGGGSGGGGSDVVMTQSPLSLPVTLGQTASISCRSTQSLVKSYGDTYLSWFQQRPGQSPRRLIYEVSNRDSGVPDRFTGSGSGTDFTLKISSVEAEDIGVYYCMQGTYWPTFGQGTRLEIKRGLGG

SEQ ID NO: 7616 - protein, 270 aa, Artificial Sequence
  Description of Artificial Sequence: Synthetic polypeptide
MKYLLPTAAAGLLLLAAQPAGAQVQLQQSGPELVKPGASVKMSCKASGYTFTDYVISWVKQRTGQGLEWIGEIYPGSGSTYYNEKFKGKATLTADKSSNTAYMQLSSLTSEDSAVYFCARSVWWGFAYWGQGTLVTVSAGGGGSGGGGSGGGGSDIVMTQSQKFMSTSVGDRVSITCKASQNVGTAVAWYQQKPGQSPKLLIYSASNRYTGVPDRFTGSGSGTDFTLTISNMQSEDLADYFCQQYSSYLYTFGGGTKLEIKRLEHHHHHH

SEQ ID NO: 7617 - protein, 218 aa, Artificial Sequence
  Description of Artificial Sequence: Synthetic polypeptide
QVQLQQSGAELVRPGVSVKISCKGSGYTFTDYGMHWVKQSHAKSLEWIGIISTYSGDASYNQKFKGKATMTVDKSSSTAYMELARLTSEDSAIYYCARSSTWYYFDYWGQGTTLTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPR

SEQ ID NO: 7618 - protein, 213 aa, Artificial Sequence
  Description of Artificial Sequence: Synthetic polypeptide
DIQVTQTTSSLSASLGDRVTISCRASQDISNYLNWYQQKPDGTVKLLIYYTSRLHSGVPSRFSGSGSGTDYSLTISNLEQEDIATYFCQQGNTLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNE

SEQ ID NO: 7619 - protein, 224 aa, Artificial Sequence
  Description of Artificial Sequence: Synthetic polypeptide
MAEVQLVESGAEVKKPGESLRISCKGSGCIISSYWISWVRQMPGKGLEWMGKIDPGDSYINYSPSFQGHVTISADKSINTAYLQWNSLKASDTAMYYCARGGRDFGDSFDYWGQGTLVTVSSGGGGSGGGGSGGGGSDVVMTQSPSFLSAFVGDRITITCRASSGISRYLAWYQQAPGKAPKLLIYAASTLQTGVPSRFSGSGSGTEFTLTINSLQPEDFATYY

SEQ ID NO: 7620 - protein, 127 aa, Artificial Sequence
  Description of Artificial Sequence: Synthetic polypeptide
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGTTGWGWLGKPIGAFQHWGQGTLVTVSS

SEQ ID NO: 7621 - protein, 114 aa, Artificial Sequence
  Description of Artificial Sequence: Synthetic polypeptide
MEIVLTQSPGTLSLSPGERATLSCRASQSVSSSYLAWYQQKPGQAPRLLIYGASSRATGIPDRFSGSGSGTDFTLTISRLEPEDFAVYYCQQYGSSPSTFGQGTKVEIKRLVPR

SEQ ID NO: 7622 - protein, 226 aa, Artificial Sequence
  Description of Artificial Sequence: Synthetic polypeptide
QVQLQESGPGVVKSSETLSLTCTVSGGSMGGTYWSWLRLSPGKGLEWIGYIFHTGETNYSPSLKGRVSISVDTSEDQFSLRLRSVTAADTAVYFCASLPRGQLVNAYFRNWGRGSLVSVTAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 7623 - protein, 209 aa, Artificial Sequence
  Description of Artificial Sequence: Synthetic polypeptide
YELTQPPSVSVSPGQTATITCSGASTNVCWYQVKPGQSPEVVIFENYKRPSGIPDRFSGSKSGSTATLTIRGTQAIDEADYYCQVWDSFSTFVFGSGTQVTVLRQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7624 - protein, 232 aa, Artificial Sequence
  Description of Artificial Sequence: Synthetic polypeptide
QVQLVQSGAEVRKPGASVTVSCKTSGYTFVNFYIVWVRQAPGQGLEWMGVINPFRGDTYFAQKFKGRVTLTRDTSTSTVFMELSSLRSDDTAIYYCARDLEMRDGNNHGSHLEFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 7625 - protein, 218 aa, Artificial Sequence
  Description of Artificial Sequence: Synthetic polypeptide
DIVMTQSPLSLPVTPGEAASISCRSSQSLLHTNGFQYLDWYLQKPGQSPQLLIYLGSNRATGVPHRFSGSGSGTEFTLKISRVEAEDVGVYYCMQAKESPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7626 - protein, 243 aa, Artificial Sequence
  Description of Artificial Sequence: Synthetic polypeptide
  MOD_RES (1)..(1): Any amino acid
XGQLVQSGAELKKPGASVKISCKTSGYRFNFYHINWIRQTAGRGPEWMGWISPYSGDKNLAPAFQDRVIMTTDTEVPVTSFTSTGAAYMEIRNLKFDDTGTYFCAKGLLRDGSSTWLPYLWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKGLEVLFQ

SEQ ID NO: 7627 - protein, 244 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHHHHHH

SEQ ID NO: 7628 - protein, 231 aa, Artificial Sequence
  Description of Artificial Sequence: Synthetic polypeptide
QVQLVESGGGVVQPGRSLRLSCAASGFTFRNYAMHWVRQAPGKGLEWVALIKYDGRNKYYADSVKGRFSISRDNSKNTLYLEMNSLRAEDTAVYYCARDIGLKGEHYDILTAYGPDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSC

SEQ ID NO: 7629 - protein, 231 aa, Artificial Sequence
  Description of Artificial Sequence: Synthetic polypeptide
EVQLVQSGAEVKKPGESLKISCKGSGYRFTSYWIVWVRQMPGKGLEWMGIIYPGDFDTKYSPSFQGQVTISADKSISTAYLQWSSLKASDTAMYYCARLGGRYYHDSSGYYYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 7630 - protein, 225 aa, Artificial Sequence
  Description of Artificial Sequence: Synthetic polypeptide
EVQLVESGGGLVQPGRSLRLSCAASGFTFDDGAMHWVRQAPGKGLEWVSGISWNSNIIAYADSVKGRFTISRDNAKNSLYLEMNSLRVEDTALYYCAKDSPRGELPLNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 7631 - protein, 235 aa, Artificial Sequence
  Description of Artificial Sequence: Synthetic polypeptide
EVQLVQSGAEVNKPGSSVKVSCQASGATLNSHAFSWVRQAPGQGLEWMAGIIPIFGSSHYAQKFRGRVTISADESTRTVYLHLRGLRSDDTAVYYCASNSIAGVAAAGDYADYDGGYYYDMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 7632 - protein, 232 aa, Artificial Sequence
  Description of Artificial Sequence: Synthetic polypeptide
QVQLVQSGAEVKKPGSSAKVSCKASRGTLSSYFISWVRQAPGQGLEWLGGITPLLGTANYAQKFQGRVTITADKSTNTAFMQLSSLTSDDTAVYYCAGTVYYDILTGLYTNFHYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 7633 - protein, 267 aa, Artificial Sequence
  Description of Artificial Sequence: Synthetic polypeptide
  MOD_RES (133)..(133): Any amino acid
  MOD_RES (136)..(136): Any amino acid
QASTMDWIWRILFLVAAATSAHSQVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLXNEXGPNYEEWGDYLATLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 7634 - protein, 231 aa, Artificial Sequence
  Description of Artificial Sequence: Synthetic polypeptide
QVQLQESGPGLVKPSQTLSLSCTVSGGSSSSGAHYWSWIRQYPGKGLEWIGYIHYSGNTYYNPSLKSRITISQHTSENQFSLKLNSVTVADTAVYYCARGTRLRTLRNAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHT

SEQ ID NO: 7635 - protein, 237 aa, Artificial Sequence
  Description of Artificial Sequence: Synthetic polypeptide
EVQLVESGGGLVKPGGSLRLSCAASGFTFSSYSMNWVRQAPGRGLEWVSSISNTSTYIYYADSVEGRFTLSRDNAKNSLYLQMNSLRAEDTAVYYCARANQHFDWLLSLLGGYHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKT

SEQ ID NO: 7636 - protein, 216 aa, Artificial Sequence
  Description of Artificial Sequence: Synthetic polypeptide
QSVLTQSASVSGSLGQSVTISCTGPNSVCCSHKSISWYQWPPGRAPTLIIYEDNERAPGISPRFSGYKSYWSAYLTISDLRPEDETTYYCCSYTHNSGCVFGTGTKVSVLGQSKANPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7637 - protein, 215 aa, Artificial Sequence
  Description of Artificial Sequence: Synthetic polypeptide
DIQMTQSPSTLSASIGDTVRISCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7638 - protein, 215 aa, Artificial Sequence
  Description of Artificial Sequence: Synthetic polypeptide
DIQMTQSPSSLSASVGDRVTITCQASQDIRNYLNWYQQKPGKAPKLLIYDASNSETGVPSRFSGSGSGRDFTFTISSLQPEDVATYYCQQHQNVPLTTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

SEQ ID NO: 7639 - protein, 216 aa, Artificial Sequence
  Description of Artificial Sequence: Synthetic polypeptide
NFMLTQPHSVSESPGKTVTISCTRSSGSVASDYVQWYQQRPGSAPTTVVYEDNQRPSGVPDRFSGSIDSSSNSASLTISGLKTEDEADYYCQSYDNSSWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7640 - protein, 215 aa, Artificial Sequence
  Description of Artificial Sequence: Synthetic polypeptide
DSYELTQPPSVSVSPGQTARITCSGDALPKNYAYWYQQKSGQAPVLVIYEDSKRPSGIPERFSGSSSGTMATLTISGAQVEDEADYYCYSTDSSGNHRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7641 - protein, 213 aa, Artificial Sequence
  Description of Artificial Sequence: Synthetic polypeptide
QSILTQPPSVSAAPGQKVTISCSGSSSNIGNNDVSWYQQFPGTVPKLVIYENNERPSGIPDRFSGSKSGTSATLGITGLQTGDEADYYCGTWDSSLSAVVFGGGSKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPT

SEQ ID NO: 7642 - protein, 209 aa, Artificial Sequence
  Description of Artificial Sequence: Synthetic polypeptide
  MOD_RES (1)..(1): Any amino acid
XIVLTQSPGILSLSPGETATLFCKASQGGNAMTWYQKRRGQVPRLLIYDTSRRASGVPDRFVGSGSGTDFFLTINKLDREDFAVYYCQQFEFFGLGSELEVHRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7643 - protein, 212 aa, Artificial Sequence
  Description of Artificial Sequence: Synthetic polypeptide
QSVLTQPPSVSVSPGQTASITCSGDNLRDGYASWYQQKPGQSPVLVIYRDDKRPSGIPERFSGSSSGNTAILTLSGAQAMDEADYYCQAWASTTVIFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7644 - protein, 239 aa, Artificial Sequence
  Description of Artificial Sequence: Synthetic polypeptide
MRLPAQLLGLLMLWVSGSGAEVVITQSPLFLPVTPGEAASLSCKCSHSLQHSTGANYLAWYLQRPGQTPRLLIHLATHRASGVPDRFSGSGSGTDFTLKISRVESDDVGTYYCMQGLHSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7645 - protein, 216 aa, Artificial Sequence
  Description of Artificial Sequence: Synthetic polypeptide
QSVLTQPPSASGSPGQSVTISCTGTSSDVGGYNYVSWYQHHPGKAPKLIISEVNNRPSGVPDRFSGSKSGNTASLTVSGLQAEDEAEYYCSSYTDIHNFVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7646 - protein, 218 aa, Artificial Sequence
  Description of Artificial Sequence: Synthetic polypeptide
DIVMTQSPLSLPVTPGEPASISCRSSQSLLHSNGYNYLDWYLQKPGQSPQLLIYLGSNRASGVPDRFIGSGSGTDFTLKISRVEAEDVGVFYCMQALQAVGFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7647 - protein, 223 aa, Artificial Sequence
  Description of Artificial Sequence: Synthetic polypeptide
QVQLVQSAAEVKKPGEALKISCKGSGYSFSNYWIAWVRQMPGKGLEWMGIVYPDDSDSSYNSSFQGQITFSADKSISTAYLHWTSLQASDTAMYYCARLGFEGDYSGSFFDYWGQGTLLIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 7648 - protein, 230 aa, Artificial Sequence
  Description of Artificial Sequence: Synthetic polypeptide
EVQLVQSGAEVKKPGESLKISCKASGYSFSSYWIAWVRQMPGKGLEWMGFIYPADSDTRYSPSFQGQGTISADKSISTAYLQWSSLKASDTAMYYCAILGFWGANRGGGGMDVWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 7649 - protein, 229 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKT

SEQ ID NO: 7650 - protein, 219 aa, Artificial Sequence
  Description of Artificial Sequence: Synthetic polypeptide
EVQLVQSGAEVKKPGATVKISCKASGYTFSDFYMYWVRQAPGKGLEWMGLIDPEDADTMYAEKFRGRVTITADTSTDTGYLELSSLRSEDTAVYYCAADPWELNAFNVWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 7651 - protein, 228 aa, Artificial Sequence
  Description of Artificial Sequence: Synthetic polypeptide
QVQLVQSGAEVKRPGSSVTVSCKASGGSFSTYALSWVRQAPGRGLEWMGGVIPLLTITNYAPRFQGRITITADRSTSTAYLELNSLRPEDTAVYYCAREGTTGWGWLGKPIGAFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 7652 - protein, 231 aa, Artificial Sequence
  Description of Artificial Sequence: Synthetic polypeptide
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARLGGRYYYDSSGYYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 7653 - protein, 233 aa, Artificial Sequence
  Description of Artificial Sequence: Synthetic polypeptide
  MOD_RES (105)..(105): Any amino acid
  MOD_RES (107)..(107): Any amino acid
EVQLVESGGNVVQPGGSLRLSCTASGFSFDDSTMHWVRQAPGKGLQWVSLISWNGGRTYYADSVKGRFTISRDNSKNSLYLQMNSLKTEDTAFYFCAKDKGDSDXDXNLGYSYFYYMDGWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7654 - protein, 233 aa, Artificial Sequence [sequence omitted]

SEQ ID NO: 7655 - protein, 206 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7656 - protein, 212 aa, Artificial Sequence
  Description of Artificial Sequence: Synthetic polypeptide
DIQMTQSPSSVSASVGDRVTITCRASQDISTWLAWYQQKPGKAPKLLIYAASTLQSGVPSRFSGSGSGTDFSLTINSLQPEDFATYYCQQANSFFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGE

SEQ ID NO: 7657 - protein, 215 aa, Artificial Sequence
  Description of Artificial Sequence: Synthetic polypeptide
EIVLTQSPGTQSLSPGERATLSCRASQSVGNNKLAWYQQRPGQAPRLLIYGASSRPSGVADRFSGSGSGTDFTLTISRLEPEDFAVYYCQQYGQSLSTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 7658 - protein, 216 aa, Artificial Sequence
  Description of Artificial Sequence: Synthetic polypeptide
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDSSSWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 7659 - protein, 213 aa, Artificial Sequence
  Description of Artificial Sequence: Synthetic polypeptide
SYVLTQPPSVSVAPGKTARITCGGNNIANKNVHWYQQKPGQAPVLVIYYDDDRPSGIPDRFSGSNSGNTATLTISRVEAGDEADYYCQVWDSNSDHVVFGGGTQLTVLGQPKAAPSVTLFPPSSEELQANKATLVCLISDFYPGAVTVAWKADGSPVKAGVETTKPSKQSNNKYAASSYLSLTPEQWKSHRSYSCQVTHEGSTVEKTVAPTEC

SEQ ID NO: 7660 - protein, 467 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7661 - protein, 467 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7662 - protein, 467 aa, Artificial Sequence
  Description of Artificial Sequence: Synthetic polypeptide
QEQLLESGGGVVQPGGSLRLSCLASGFTFHKYGMHWVRQAPGKGLEWVALISDDGMRKYHSNSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7663 - protein, 467 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTIVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7664 - protein, 137 aa, Artificial Sequence
  Description of Artificial Sequence: Synthetic polypeptide
HEQLVEAGGGVVQPGGSLRLSCLASGFTFHKYGMHWVRQAPGKGLEWVALISDDGMRKYHSDSMWGRVTISRDNSKNTLYLQFSSLRVEDTAMFFCAREAGGPIWHDDVKYYDFNDGYYNYHYMDVWGKGTKVTVSS

SEQ ID NO: 7665 - protein, 124 aa, Artificial Sequence
  Description of Artificial Sequence: Synthetic polypeptide
QVRLVQSGPEVKKPGSSVTVSCQASGGTFSSYAFTWVRQAPGQGLEWLGMVTPIFGEAKYSQRFEGRVTITADESTSTTSIELRGLTSEDTAIYYCARDRRAVPIATDNWLDPWGQGTLVTVSS

SEQ ID NO: 7666 - protein, 124 aa, Artificial Sequence
  Description of Artificial Sequence: Synthetic polypeptide
QVLLVQSGTEVKKPGSSVKVSCQASGGAFSSYAFSWVRQAPGQGLEWMGMITPVFGETKYAPRFQGRLTLTAEESLSTTYMELRSLTSDDTAFYYCTRDRRVVPMATDNWLDPWGQGTLVTVSS

SEQ ID NO: 7667 - protein, 137 aa, Artificial Sequence
  Description of Artificial Sequence: Synthetic polypeptide
QEKLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

SEQ ID NO: 7668 - protein, 137 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

SEQ ID NO: 7669 - protein, 464 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLS

SEQ ID NO: 7670 - protein, 137 aa, Artificial Sequence
  Description of Artificial Sequence: Synthetic polypeptide
QEQLLESGGGVVQPGGSLRLSCLASGFTFHKYGMHWVRQAPGKGLEWVALISDDGMRKYHSNSMWGRVTISRDNSKNTLYLQFSSLKVEDTAMFFCAREAGGPIWHDDVKYYDFNDGYYNYHYMDVWGKGTTVTVSS

SEQ ID NO: 7671 - protein, 122 aa, Artificial Sequence
  Description of Artificial Sequence: Synthetic polypeptide
DGHLVQSGVEVKKTGATVKISCKVSGYSFIDYYLHWVQRAPGKGLEWVGLIDPENGEARYAEKFQGRVTIIADTSIDTGYMEMRSLKSEDTAVYFCAAGAVGADSGSWFDPWGQGTLVTVSS

SEQ ID NO: 7672 - protein, 216 aa, Artificial Sequence
  Description of Artificial Sequence: Synthetic polypeptide
QSALTQPASVSGSPGQTITISCNGTRSDVGGFDSVSWYQQSPGKAPKVMVFDVSHRPSGISNRFSGSKSGNTASLTISGLHIEDEGDYFCSSLTDRSHRIFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 7673 - protein, 136 aa, Artificial Sequence
  Description of Artificial Sequence: Synthetic polypeptide
QRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVTVSS

SEQ ID NO: 7674 - protein, 467 aa, Artificial Sequence
  Description of Artificial Sequence: Synthetic polypeptide
HEQLVEAGGGVVQPGGSLRLSCLASGFTFHKYGMHWVRQAPGKGLEWVALISDDGMRKYHSDSMWGRVTISRDNSKNTLYLQFSSLRVEDTAMFFCAREAGGPIWHDDVKYYDFNDGYYNYHYMDVWGKGTKVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7675 - protein, 453 aa, Artificial Sequence
  Description of Artificial Sequence: Synthetic polypeptide
QVLLVQSGTEVKKPGSSVKVSCQASGGAFSSYAFSWVRQAPGQGLEWMGMITPVFGETKYAPRFQGRLTLTAEESLSTTYMELRSLTSDDTAFYYCTRDRRVVPMATDNWLDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 7676 - protein, 452 aa, Artificial Sequence
  Description of Artificial Sequence: Synthetic polypeptide
DGHLVQSGVEVKKTGATVKISCKVSGYSFIDYYLHWVQRAPGKGLEWVGLIDPENGEARYAEKFQGRVTIIADTSIDTGYMEMRSLKSEDTAVYFCAAGAVGADSGSWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7677 - protein, 466 aa, Artificial Sequence
  Description of Artificial Sequence: Synthetic polypeptide
QRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7678 - protein, 454 aa, Artificial Sequence
  Description of Artificial Sequence: Synthetic polypeptide
QVRLVQSGPEVKKPGSSVTVSCQASGGTFSSYAFTWVRQAPGQGLEWLGMVTPIFGEAKYSQRFEGRVTITADESTSTTSIELRGLTSEDTAIYYCARDRRAVPIATDNWLDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7679 - protein, 131 aa, Artificial Sequence
  Description of Artificial Sequence: Synthetic polypeptide
  MOD_RES (3)..(3): Any amino acid
  MOD_RES (5)..(5): Any amino acid
  MOD_RES (77)..(77): Any amino acid
  MOD_RES (128)..(128): Any amino acid
EVXLXESGGGLVKPGGSLRLSCSASGFDFDNAWMTWVRQPPGKGLEWVGRITGPGEGWSVDYAAPVEGRFTISRLNXINFLYLEMNNLRMEDSGLYFCARTGKYYDFWSGYPPGEEYFQDWGRGTLVXVSS

SEQ ID NO: 7680 - protein, 131 aa, Artificial Sequence
  Description of Artificial Sequence: Synthetic polypeptide
  MOD_RES (3)..(3): Any amino acid
  MOD_RES (5)..(5): Any amino acid
  MOD_RES (28)..(28): Any amino acid
  MOD_RES (30)..(31): Any amino acid
  MOD_RES (57)..(57): Any amino acid
  MOD_RES (128)..(128): Any amino acid
EVXLXESGGGLVKPGGSLRLSCSASGFXFXXAWMTWVRQPPGKGLEWVGRITGPGEXWSVDYAAPVEGRFTISRLNSINFLYLEMNNLRMEDSGLYFCARTGKYYDFWSGYPPGEEYFQDWGRGTLVXVSS

SEQ ID NO: 7681 - protein, 131 aa, Artificial Sequence
  Description of Artificial Sequence: Synthetic polypeptide
  MOD_RES (2)..(3): Any amino acid
  MOD_RES (5)..(5): Any amino acid
  MOD_RES (10)..(10): Any amino acid
  MOD_RES (13)..(13): Any amino acid
  MOD_RES (23)..(23): Any amino acid
  MOD_RES (28)..(28): Any amino acid
  MOD_RES (30)..(32): Any amino acid
  MOD_RES (40)..(40): Any amino acid
  MOD_RES (52)..(52): Any amino acid
  MOD_RES (54)..(54): Any amino acid
  MOD_RES (56)..(57): Any amino acid
  MOD_RES (59)..(61): Any amino acid
  MOD_RES (64)..(65): Any amino acid
  MOD_RES (67)..(67): Any amino acid
  MOD_RES (71)..(71): Any amino acid
  MOD_RES (75)..(81): Any amino acid
  MOD_RES (84)..(84): Any amino acid
  MOD_RES (87)..(91): Any amino acid
  MOD_RES (93)..(95): Any amino acid
  MOD_RES (97)..(97): Any amino acid
  MOD_RES (99)..(100): Any amino acid
  MOD_RES (102)..(102): Any amino acid
  MOD_RES (104)..(104): Any amino acid
  MOD_RES (106)..(106): Any amino acid
  MOD_RES (109)..(109): Any amino acid
  MOD_RES (111)..(111): Any amino acid
  MOD_RES (118)..(120): Any amino acid
  MOD_RES (123)..(123): Any amino acid
  MOD_RES (126)..(126): Any amino acid
  MOD_RES (128)..(128): Any amino acid
  MOD_RES (130)..(130): Any amino acid
EXXLXESGGXLVXPGGSLRLSCXASGFXFXXXWMTWVRQXPGKGLEWVGRIXGXGXXWXXXYAXXVXGRFXISRXXXXXXXYLXMNXXXXXDXXXYXCXXTXKXYXFWXGXPPGEEYXXXWGXGTXVXVXS

SEQ ID NO: 7682 - protein, 109 aa, Artificial Sequence
  Description of Artificial Sequence: Synthetic polypeptide
  MOD_RES (1)..(3): Any amino acid
  MOD_RES (7)..(9): Any amino acid
  MOD_RES (14)..(16): Any amino acid
  MOD_RES (19)..(19): Any amino acid
  MOD_RES (23)..(23): Any amino acid
  MOD_RES (29)..(30): Any amino acid
  MOD_RES (32)..(33): Any amino acid
  MOD_RES (37)..(40): Any amino acid
  MOD_RES (44)..(44): Any amino acid
  MOD_RES (46)..(47): Any amino acid
  MOD_RES (49)..(52): Any amino acid
  MOD_RES (56)..(58): Any amino acid
  MOD_RES (63)..(65): Any amino acid
  MOD_RES (69)..(69): Any amino acid
  MOD_RES (75)..(75): Any amino acid
  MOD_RES (78)..(80): Any amino acid
  MOD_RES (82)..(82): Any amino acid
  MOD_RES (84)..(84): Any amino acid
  MOD_RES (98)..(99): Any amino acid
  MOD_RES (102)..(102): Any amino acid
  MOD_RES (105)..(109): Any amino acid
XXXLTQXXXVSVAXXXTVXITCXGDSLRXXYXXWYQXXXXQAPXLXXYXXXXRPSXXXDRFSXXXSGNXASLTIXGAXXXDXAXYYCSSRDKSGSRLXXFGXGTXXXXX

SEQ ID NO: 7683 - protein, 131 aa, Artificial Sequence
  Description of Artificial Sequence: Synthetic polypeptide
EVRLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGRGTLVIVSS

SEQ ID NO: 7684 - protein, 131 aa, Artificial Sequence
  Description of Artificial Sequence: Synthetic polypeptide
EVRLAESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGRGTLVIVSS

SEQ ID NO: 7685 - protein, 131 aa, Artificial Sequence
  Description of Artificial Sequence: Synthetic polypeptide
EVRLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGQGTLVIVSS

SEQ ID NO: 7686 - protein, 131 aa, Artificial Sequence
  Description of Artificial Sequence: Synthetic polypeptide
EVRLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGQGTLVIVPS

SEQ ID NO: 7687 - protein, 131 aa, Artificial Sequence
  Description of Artificial Sequence: Synthetic polypeptide
EVRLAESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGQGTLVIVPS

SEQ ID NO: 7688 - protein, 131 aa, Artificial Sequence
  Description of Artificial Sequence: Synthetic polypeptide
EVRLVESGGGLVKPGGSLRLSCSASGFNFDDAWMTWVRQPPGKGLEWVGRISGPGEGWSVDYAESVKGRFTISRLNSINFLYLEMNNVRTEDTGYYFCARTGKHYDFWSGYPPGEEYFQDWGQGTLVIVSS

SEQ ID NO: 7689 - protein, 131 aa, Artificial Sequence
  Description of Artificial Sequence: Synthetic polypeptide
EVRLVESGGRLVRPGGSLRLSCSASGFNFDNAWMTWVRQPPGKGLEWVGRITGPGEGWSVDYAASVKGRFTISRMNSINFFYLEMNNLKIEDTGLYFCARTGKHYAFWGGYPPGEEYLEDWGQGTLVIVSS

SEQ ID NO: 7690 - protein, 131 aa, Artificial Sequence; identical to SEQ ID NO: 7689
  Description of Artificial Sequence: Synthetic polypeptide

SEQ ID NO: 7691 - protein, 131 aa, Artificial Sequence
  Description of Artificial Sequence: Synthetic polypeptide
EIRLVESGGGLVKPGGSLRLSCSASGFNFDSAWMTWVRQPPGKGLEWVGRITGPGEGWSVDYAESVKGRFIISRINSINFLYLEMNNLRPEDTGSYFCAHTGKHYDFWRGYPPGEEYFQDWGQGTQVIVSS

SEQ ID NO: 7692 - protein, 131 aa, Artificial Sequence
  Description of Artificial Sequence: Synthetic polypeptide
EIRLVESGGGLVKPGGSLRLSCSASGFNFDSAWMTWVRQPPGKGLEWVGRITGPGEGWSVGYAESVKGRFIISRINSINFLYLEMNNLRPEDTGSYFCAHTGKHYDFWRGYPPGEEYFQDWGQGTQVIVSS

SEQ ID NO: 7693 - protein, 131 aa, Artificial Sequence
  Description of Artificial Sequence: Synthetic polypeptide
EVQLVESGGDLVKPGGSLRLSCSASGFSFKNTWMTWVRQAPGKGLEWVGRITGPGEGWTSDYAATVQGRFTISRNNMIDMLYLEMNRLRTDDTGLYYCVHTEKYYNFWGGYPPGEEYFQHWGRGTLVIVSS

SEQ ID NO: 7694 - protein, 131 aa, Artificial Sequence
  Description of Artificial Sequence: Synthetic polypeptide
EVRLAESGGGLVKPGGSLRLSCSASGFDFDNAWMTWVRQPPGKGLEWVGRITGPGEGWSVDYAAPVEGRFTISRLNAINFLYLEMNNLRMEDSGLYFCARTGKYYDFWSGYPPGEEYFQDWGRGTLVIVSS

SEQ ID NO: 7695 - protein, 131 aa, Artificial Sequence
  Description of Artificial Sequence: Synthetic polypeptide
EVRLAESGGGLVKPGGSLRLSCSASGFDFDNAWMTWVRQPPGKGLEWVGRITGPGEGWSVDYAAPVEGRFTISRLNRINFLYLEMNNLRMEDSGLYFCARTGKYYDFWSGYPPGEEYFQDWGRGTLVIVSS

SEQ ID NO: 7696 - protein, 131 aa, Artificial Sequence
  Description of Artificial Sequence: Synthetic polypeptide
EVRLAESGGGLVKPGGSLRLSCSASGFDFDNAWMTWVRQPPGKGLEWVGRITGPGEGWSVDYAAPVEGRFTISRLNVINFLYLEMNNLRMEDSGLYFCARTGKYYDFWSGYPPGEEYFQDWGRGTLVIVSS

SEQ ID NO: 7697 - protein, 131 aa, Artificial Sequence
  Description of Artificial Sequence: Synthetic polypeptide
EVRLAESGGGLVKPGGSLRLSCSASGFDFDNAWMTWVRQPPGKGLEWVGRITGPGEGWSVDYAAPVEGRFTISRLNYINFLYLEMNNLRMEDSGLYFCARTGKYYDFWSGYPPGEEYFQDWGRGTLVIVSS

SEQ ID NO: 7698 - protein, 131 aa, Artificial Sequence
  Description of Artificial Sequence: Synthetic polypeptide
EVRLAESGGGLVKPGGSQRLSCSASGFDFDNAWMTWVRQPPGKGLEWVGRITGPGEGWSVDYAAPVEGRFTISRLNYINFLYLEMNNLRTEDSGLYFCARTGKYYDFWSGYPPGEEYFQDWGRGTLVIVSS

SEQ ID NO: 7699 - protein, 131 aa, Artificial Sequence
  Description of Artificial Sequence: Synthetic polypeptide
EVRLAESGGGLVKPGGSLRLSCSASGFDFDNAWMTWVRQPPGKGLEWVGRITGPGEGWSVDYAAPVEGRFTISRDNYKNTLYLEMNNLRTEDSGLYFCARTGKYYDFWSGYPPGEEYFQDWGRGTLVIVSS

SEQ ID NO: 7700 - protein, 131 aa, Artificial Sequence
  Description of Artificial Sequence: Synthetic polypeptide
EVRLAESGGGLVKPGGSQRLSCSASGFDFDNAWMTWVRQPPGKGLEWVGRITGPGEGKSVDYAAPVEGRFTISRLNYINFLYLEMNNLRTEDSGLYFCARTGKYYDFWSGYPPGEEYFQDWGRGTLVIVSS

SEQ ID NO: 7701 - protein, 131 aa, Artificial Sequence
  Description of Artificial Sequence: Synthetic polypeptide
EVRLAESGGGLVKPGGSQRLSCSASGFDFDNAWMTWVRQPPGKGLEWVGRITGPGEGKSVDYAAPVEGRFTISRDNYKNTLYLEMNNLRTEDSGLYFCARTGKYYDFWSGYPPGEEYFQDWGRGTLVIVSS

SEQ ID NO: 7702 - protein, 131 aa, Artificial Sequence
  Description of Artificial Sequence: Synthetic polypeptide
EVRLAESGGGLVKPGGSLRLSCAASGFDFDNAWMTWVRQPPGKGLEWVGRITGPGEGWSVDYAAPVEGRFTISRLDYINFLYLQMNSLKMEDTGVYYCARTGKYYDFWSGYPPGEEYFQDWGQGTLVIVSS

SEQ ID NO: 7703 - protein, 109 aa, Artificial Sequence
  Description of Artificial Sequence: Synthetic polypeptide
SYELTQETGVSVALGRTVTITCQGDSLRSHYASWYQKKPGQAPILLFYGKNNRPSGVPDRFSGSASGNRASLTISGAQAEDDAEYYCSSRDKSGSRLSVFGGGTKLTVL

SEQ ID NO: 7704 - protein, 109 aa, Artificial Sequence
  Description of Artificial Sequence: Synthetic polypeptide
SYELTQDTGVSVALGRTVTITCQGDSLRSHYASWYQKKPGQAPVLLFYGKNNRPSGIPDRFSGSASGNRASLTITGAQAEDEADYYCSSRDKSGSRLSVFGGGTKLTVL

SEQ ID NO: 7705 - protein, 109 aa, Artificial Sequence
  Description of Artificial Sequence: Synthetic polypeptide
SSELTQDTGVSVALGRTVTITCQGDSLRSHYASWYQKKPGQAPKLLFYGKNNRPSGIPDRFSGSASGNRASLTITGAQAEDEADYYCSSRDKSGSRLSVFGGGTKLTVL

SEQ ID NO: 7706 - protein, 109 aa, Artificial Sequence
  Description of Artificial Sequence: Synthetic polypeptide
SYELTQDTGTSVAAGRTVTITCQGDSLRSHYASWYQKKPGQAPVLLFYGKNNRPSGIPDRFSGSASGNRASLTITGAQAEDEADYYCSSRDKSGSRLSVFGGGTKLTVP

SEQ ID NO: 7707 - protein, 109 aa, Artificial Sequence
  Description of Artificial Sequence: Synthetic polypeptide
SSELTQDTGTSVAAGRTVTITCQGDSLRSHYASWYQKKPGQAPKLLFYGKNNRPSGIPDRFSGSASGNRASLTITGAQAEDEADYYCSSRDKSGSRLSVFGGGTKLTVP

SEQ ID NO: 7708 - protein, 109 aa, Artificial Sequence
  Description of Artificial Sequence: Synthetic polypeptide
  MOD_RES (31)..(31): Any amino acid
  MOD_RES (44)..(44): Any amino acid
  MOD_RES (57)..(57): Any amino acid
  MOD_RES (107)..(107): Any amino acid
SYELTQETGVSVALGRTVTITCRGDSLRSHXASWYQKKPGQAPXLLFYGKNNRPSGXPDRFSGSASGNRASLTISGAQAEDDAEYYCSSRDKSGSRLSVFGGGTKLXVL

SEQ ID NO: 7709 - protein, 109 aa, Artificial Sequence
  Description of Artificial Sequence: Synthetic polypeptide
SSELTQETGVSVALGRTVTITCRGDSLRSHYASWYQKKPGQAPILLFYGKNNRPSGIHDRFSGSASGNRASLTISGAQAEDDAEYYCSSRDKSGSRLSVFGGGTKLTVL

SEQ ID NO: 7710 - protein, 109 aa, Artificial Sequence
  Description of Artificial Sequence: Synthetic polypeptide
SSELTQETGVSVALGRTVTITCRGDSLRSHYASWYQKKPGQAPKLLFYGKNNRPSGIPDRFSGSASGNRASLTISGAQAEDDAEYYCSSRDKSGSRLSVFGGGTKLTVL

SEQ ID NO: 7711 - protein, 109 aa, Artificial Sequence
  Description of Artificial Sequence: Synthetic polypeptide
SSELTQETGVSVALGRTVTITCRGDSLRSHYASWYQKKPGQAPKLLFYGKNNRPSGIPDRFSGSASGNRASLTISGAQAEDDAEYICSSRDKSGSRLSVFGGGTKLTVL

SEQ ID NO: 7712 - protein, 109 aa, Artificial Sequence
  Description of Artificial Sequence: Synthetic polypeptide
SSELTQETGVSVALGRTVTITCRGDSLRSHYASWYQKKPGQAPKLLFYGKNNRPSGIPDRFSGFASGNRASLTISGAQAEDDAEYYCSSRDKSGSRLSVFGGGTKLTVL

SEQ ID NO: 7713 - protein, 109 aa, Artificial Sequence
  Description of Artificial Sequence: Synthetic polypeptide
SSELTQETGVSVALGRTVTITCRGDSLRSHYASWYQEKPGQAPKLLFYGKNNRPSGIPDRFSGSASGNRASLTISGAQAEDDAEYYCSSRDKSGSRLSVFGGGTKLAVL

SEQ ID NO: 7714 - protein, 109 aa, Artificial Sequence
  Description of Artificial Sequence: Synthetic polypeptide
SSELTQDPGVSVALKQTVTITCRGDSLRSHYVSWYQKKPGQAPVLVFYGKNNRPSGIPDRFSGSTSGNTASLTIAGAQAEDDADYYCSSRDKSGSRLSVFGGGTKLTVL

SEQ ID NO: 7715 - protein, 109 aa, Artificial Sequence
  Description of Artificial Sequence: Synthetic polypeptide
ASELTQDPGVSVALKQTVTITCRGDSLRSHYVSWYQKKPGQAPVLVFYGKNNRPSGIPDRFSGSTSGNTASLTIAGAQAEDDADYYCSSRDKSGSRLSVFGGGTKLTVL

SEQ ID NO: 7716 - protein, 109 aa, Artificial Sequence
  Description of Artificial Sequence: Synthetic polypeptide
ASELTQDPGVSVALEQTVTITCRGDSLRSHYVSWYQKKPGQAPVLVFYGKNNRPSGIPDRFSGSTSGNTASLTIAGAQAEDDADYYCSSRDKSGSRLSVFGGGTKLTVL

SEQ ID NO: 7717 - protein, 109 aa, Artificial Sequence
  Description of Artificial Sequence: Synthetic polypeptide
ASELTQDPGVSVALKQTVTITCRGDSLRSHYVSWYQKRPGQAPVLVFYGKNNRPSGIPDRFSGSTSGNTASLTIAGAQAEDDADYYCSSRDKSGSRLSVFGGGTKLTVL

SEQ ID NO: 7718 - protein, 109 aa, Artificial Sequence
  Description of Artificial Sequence: Synthetic polypeptide
ASELTQDPAVSVALKQTVTITCRGDSLRSHYVSWYQKKPGQAPVLVFYGKNNRPSGIPDRFSGSSSGNTASLTIAGAQAEDDADYYCSSRDKSGSRLSVFGGGTKLTVL

SEQ ID NO: 7719 - protein, 109 aa, Artificial Sequence
  Description of Artificial Sequence: Synthetic polypeptide
SSELTQDPGVSVALKQTVTITCRGDSLRSHYVSWYQKKPGQAPVLVFYGKNIGPSGIPDRFSGSTSGNTASLTIAGAQAEDDADYYCSSRDKSGSRLSVFGGGTKLTVL

SEQ ID NO: 7720 - protein, 109 aa, Artificial Sequence
  Description of Artificial Sequence: Synthetic polypeptide
ASELTQDPAVSVALKQTVTITCRGDSLRSHYVSWYQQKPGQAPVLVFYGKNNRPSGIPDRFSGSSSGNTASLTIAGAQAEDDADYYCSSRDKSGSRLSVFGGGTKLTVL

SEQ ID NO: 7721 - protein, 109 aa, Artificial Sequence
  Description of Artificial Sequence: Synthetic polypeptide
ASELTQDPAVSVAFEKTVTITCQGDSLRSHYVSWYQKRPGQAPVLVFYGKNNRPSGIPDRFSGSTSGNTASLTIAGAQAEDDADYYCSSRDKSGSRLSVFGGGTKLTVP

SEQ ID NO: 7722 - protein, 109 aa, Artificial Sequence
  Description of Artificial Sequence: Synthetic polypeptide
SSDLTQDPAVSVALGQTVRITCQGDSLRRYYAGWYQQKPGQAPVLVVYGRDNRPSGIPDRFSGSTSGNTASLTIAGAQAEDDADYYCSSRDKSGSRLSVFGGGTKLTVL

SEQ ID NO: 7723 - protein, 109 aa, Artificial Sequence
  Description of Artificial Sequence: Synthetic polypeptide
ASELTQDPTVSVALGQTVTITCRGDSLRNHYTSWYQQKTGQAPILLIYPKHNRPPGISDRFSASSSGNTASLTITGAQTEDEGDYYCSSRDKSGSRLVTFGGGTKLTVL

SEQ ID NO: 7724 - protein, 109 aa, Artificial Sequence
  Description of Artificial Sequence: Synthetic polypeptide
ASELTQDPTVSVALGQTVTITCRGDSLRNYYTSWYQQKPGQAPVLLIYPKHNRPPGISDRFSASSSGNTASLTITGAQTEDEGDYYCSSRDKSGSRLVTFGGGTKLTVL

SEQ ID NO: 7725 - protein, 109 aa, Artificial Sequence
  Description of Artificial Sequence: Synthetic polypeptide
ASELTQDPTVSVALGQTVTITCRGDSLRNYYTSWYQQKPRQAPVLLIYPKHNRPPGISDRFSASSSGNTASLTITGAQTEDEGDYYCSSRDKSGSRLVTFGGGTKLTVL

SEQ ID NO: 7726 - protein, 109 aa, Artificial Sequence
  Description of Artificial Sequence: Synthetic polypeptide
ASELTQDPTVSVALGQTVTITCRGDSLRNHYTSWYQQKTGQAPVLLIYPKHNRSPGISDRFSASSSGNTASLTITGAQTEDEGDYYCSSRDKSGSRLVTFGGGTKVTVL

SEQ ID NO: 7727 - protein, 109 aa, Artificial Sequence
  Description of Artificial Sequence: Synthetic polypeptide
ASELTQDPTVSVALGQTVTITCRGDSLRNYYTSWYQQKPGQAPVLLIYPKHNRPPGISDRFSASSSGNTASLTITGAQTEDEGDYYCSSRDKSGSRLVTFGRGTKLTVV

SEQ ID NO: 7728 - protein, 109 aa, Artificial Sequence
  Description of Artificial Sequence: Synthetic polypeptide
ASELTQDPTVSVALGQTVTITCRGDSLRNYYTSWYQQKPGQAPVLLIYPKHNRPPGISDRFSASSSGNTASLTITGAQTEDEGDYYCSSRDKSGSRLVTFGGGTKVTGL

SEQ ID NO: 7729 - protein, 109 aa, Artificial Sequence
  Description of Artificial Sequence: Synthetic polypeptide
ASELTQDPTVSVALGQTVTITCRGDSLRNHYTSWYQQKTGQAPVLLIYPKHNRSPGISDRFSASSSGNTASLTITGAQTEDEGDYYCSSRDKSGSRLVTFGGGTKVTVV

SEQ ID NO: 7730 - protein, 109 aa, Artificial Sequence
  Description of Artificial Sequence: Synthetic polypeptide
ASELTQDPTVSVALGQTVTITCRGDSLRNHYTSWYQQKTGQAPVLLIYPKHNRSPGISDRFSASSSGNTASLTITGAQTEDEGDYYCSSRDKSGSRLVTFGGGTEVTGL

SEQ ID NO: 7731 - protein, 109 aa, Artificial Sequence
  Description of Artificial Sequence: Synthetic polypeptide
ASELTQDPTVSVALGQTVTITCRGDSLRNHYTSWYQQKTGQAPVLLIYPKHNRSPGISDRFSRSSSGNTASLTITGAQTEDEGDYYCSSRDKSGSRLVTFGGGTERSTV

SEQ ID NO: 7732 - protein, 109 aa, Artificial Sequence
  Description of Artificial Sequence: Synthetic polypeptide
SSELTQDTGVSVALGRTVTITCRGDSLRSHYASWYQKKPGQAPKLLFYGKNNRPSGIPDRFSGSASGNRASLTITGAQAEDEADYYCSSRDKSGSRLSVFGGGTKLTVL

SEQ ID NO: 7733 - protein, 109 aa, Artificial Sequence
  Description of Artificial Sequence: Synthetic polypeptide
SYELTQDTGTSVAAGRTVTITCRGDSLRSHYASWYQKKPGQAPVLLFYGKNNRPSGIPDRFSGSASGNRASLTITGAQAEDEADYYCSSRDKSGSRLSVFGGGTKLTVP

SEQ ID NO: 7734 - protein, 109 aa, Artificial Sequence
  Description of Artificial Sequence: Synthetic polypeptide
SSELTQDTGTSVAAGRTVTITCRGDSLRSHYASWYQKKPGQAPKLLFYGKNNRPSGIPDRFSGSASGNRASLTITGAQAEDEADYYCSSRDKSGSRLSVFGGGTKLTVP

SEQ ID NO: 7735 - protein, 234 aa, Artificial Sequence
  Description of Artificial Sequence: Synthetic polypeptide
QVQLVESGSAMRKPGSSVKISCRASGFNFREYSIHWVRLIPGRGLEWMGWIKGMWGAVNYARQLQGRVSMTRQLSQDPDDPDWGVAYLDFSGLTSGDTGEYFCVRKGPSCPHCGDFHWQHWGQGTLVVVSTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7736 - protein, 223 aa, Artificial Sequence
  Description of Artificial Sequence: Synthetic polypeptide
EVQLVGSGGGLIQPGGSLRLSCAASDFSVSEYYMTWVRQAPGKGLEWVAVLYKDGSQFYAPSVKGRFIVSRDNSKNSLYLQMNNLRGEDTAVYFCARENADYGSDYYFGMDVWGQGTAVAVSSASTKGPSVFPLAPSSKSTSGGTAALGCLVKDYFPEPVTVSWNSGALTSSVHTFPAVLQSSGLYSLSSVVTVPSSSLGTQTYICNVNHKPSNTKVDKKAEP

SEQ ID NO: 7737 - protein, 131 aa, Artificial Sequence
  Description of Artificial Sequence: Synthetic polypeptide
QVQLVAGLGREVRKVWGSVKVSCSFSGFTITSYGIHWVQQSPGQGLEWMGWINPGNGSPSYAKKFQGRFTMTRDMSTTTAYTDLSLTSEDMAVYYYAYPGFPSYYYDSSGYYYEPLLWYWGQGTLVTVSSG

SEQ ID NO: 7738 - protein, 121 aa, Artificial Sequence
  Description of Artificial Sequence: Synthetic polypeptide
QVQLVQSGAEMKKPGASVKVSCKSSGYTFTYYSIHWVRQAPGQGLEWMGRSNTASDNTKYSQEFQVRVAITRDTSANTTYVELSSLRSDAVDVYYCGRVSWHRFCRGIGYWGQGLTVTVSS

SEQ ID NO: 7739 - protein, 245 aa, Artificial Sequence
  Description of Artificial Sequence: Synthetic polypeptide
QVQLVQSGAEVKKPGSSVKVSCKASGGTFNSYAFSWVRQAPGQGLEWMGSIIPLFGFVVYAQKFQGRVTITADESTSTAYMELSSLRSEDTAVYYCARYFDTYNNYGFANWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFEQKLISEEDLNGAPHHHHHH

SEQ ID NO: 7740 - protein, 120 aa, Artificial Sequence
  Description of Artificial Sequence: Synthetic polypeptide
QVQLVESGREVKKPGPSVKVSCQASGYRFTDQHLNWIRQAPGQGFEWLGRFNPANGGTDLAQKFQVRVSMTRNMSITTAYLELSRLTSDDTATYYCLNSGWTNEYHYDHWGQGTPVTVSS

SEQ ID NO: 7741 - protein, 124 aa, Artificial Sequence
  Description of Artificial Sequence: Synthetic polypeptide
QVQLVQSGAEVKKPGASLKLSCKTSGKTFNTYYWQWVRQAPGQRLEWLGVFSPRDAVTKYARAFQGRLTVTRDTSTGTTYMELSSLRVDDTAMYYCATSLFVAAPDRILLTIWGQGTMVIVSSA

SEQ ID NO: 7742 - protein, 120 aa, Artificial Sequence
  Description of Artificial Sequence: Synthetic polypeptide
QVQLVQSGAEVKKPGASVKVSCQASGYRFTDQHLNWIRQAPGQGFEWLGRFNPANGGTDLAQKFQGRVSMTRNMSITTAYLELSRLTSDDTATYYCLNSGWTNEYHYDHWGQGTPVTVSS

SEQ ID NO: 7743 - protein, 126 aa, Artificial Sequence
  Description of Artificial Sequence: Synthetic polypeptide
QVQLVQPGAEVKKPASSVKVSCQASRYTFTKHFTQWVRRGPGQGHEWLACFKPYNNHTHYAQNFWGRLTTSTDRSVHTAYMDLSSVRSEDMVRVFLCAIPEVERVTLILVVIIRWGQGTLVTVASG

SEQ ID NO: 7744 - protein, 123 aa, Artificial Sequence
  Description of Artificial Sequence: Synthetic polypeptide
QVQLVQSGAEVKKPGASVKVSCQASGYTFTDYYIHWVRQAPGQGLEWMGWINPNSGGTNYAQKFQGTVTVTRDTSIGTAYMELSRLRSDDTAVYYCARGDYYDTNSGSRFDPWGQGLWSPSPQ

SEQ ID NO: 7745 - protein, 119 aa, Artificial Sequence
  Description of Artificial Sequence: Synthetic polypeptide
QVQLVQSGVEVKKPGASVKVSCKVSGYFLSKISIHWVRQAPEKGLEWMGGFDAEQGETVYAQKFQGRVTVTEDTSTDTAYMDVSSLRSEDTAVYYCATGIRGRPLISWGQGTVVTVSSA

SEQ ID NO: 7746 - protein, 122 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARLRRDSSGFYYFDYWGQGTLVTVSS

SEQ ID NO: 7747 - protein, 123 aa, Artificial Sequence
  Description of Artificial Sequence: Synthetic polypeptide
QVQLVQSGPVIKKPGTSVQVSCKASGFTFSSYVIQWVRQTRGQRLEWIGWIVVGSGITNCAQNFQERVTLIRDMSTDTAYMELNSLGSEDTALYYCAAEPLRFPRVGWSIPWGQGTLVIVSSA

SEQ ID NO: 7748 - protein, 124 aa, Artificial Sequence
  Description of Artificial Sequence: Synthetic polypeptide
QVQLVQSGAEVRKPGASVKVSCKASGYTFTDYYIHWVRQVPGQGLEWIGWIHPNSGRATHTQKFQGRVTMTSGTSISTVYMELTGLTPDDTAVYYCARDNYRNNVWVLYTFDYWGQGTLVTVSS

SEQ ID NO: 7749 - protein, 121 aa, Artificial Sequence
  Description of Artificial Sequence: Synthetic polypeptide
QVQLVQSGAEVKKPGASMRVSCQTSGYTFNSYYIHWMRQVPGQGLEWMGWINPNSGYTNYTQKFQGRVTMTRDTSINTAYLELSALRSDETAVYYCARDFSDGWPYSFDFWGQGTLVTVSS

SEQ ID NO: 7750 - protein, 121 aa, Artificial Sequence
  Description of Artificial Sequence: Synthetic polypeptide
QVQLVPSGAEVKKPGASMRVSCQTSGYTFNSYYIHWMRQVPGQGLEWMGWINPNSGYTNYTQKFQDRVTMTRDTSINTAYLELSALRSDETAVYYCARDFSDGWPYSFDFWGQGTLVTVSS

SEQ ID NO: 7751 - protein, 123 aa, Artificial Sequence
  Description of Artificial Sequence: Synthetic polypeptide
QVQLVQSGPEAGRPGASVKVSCKASGYIFTSYPIGWVRQAPGQRLEWMGWMNPFNGYVKSAQEFQDRLTLSTNNSAHTAYMELRSLTSDDTAIYFCARVQFDSKYYTFFDLWGQGTLVTVSSA

SEQ ID NO: 7752 - protein, 124 aa, Artificial Sequence
  Description of Artificial Sequence: Synthetic polypeptide
QVQLVQSGPEVKKPGASVKVSCKASGYTYNTYYMHWVRQAPGQGLEWMGWINPNSGGTNYAQRFQTRVDMTRDTSINTVYMELSGLTSDDTAVYYCVTDFNGGSSFPFTTLTTWGQGTLVTVSS

SEQ ID NO: 7753 - protein, 118 aa, Artificial Sequence
  Description of Artificial Sequence: Synthetic polypeptide
QVQLVQSGAELKRPGASVRVSCQTSGNTFNNHDVNWIRQAPGGGLEWMGWMNVKFGGSGHIHKFDHRHTFNRDTTINAAYLDLKNLKVDDTAFYYCVVATGSAYDIWGHGTLVSVSSA

SEQ ID NO: 7754 - protein, 125 aa, Artificial Sequence
  Description of Artificial Sequence: Synthetic polypeptide
QVQLVQSGAEVKKVGSSVTLSCKISGGTFYDFAVNWVRQAPGQGLEWVGAVIPMFGTPIYPPKFRHRVTVSSYGSMTTVYMELRNLTFEDTAIYYCARDGREGVNPACQWLDPWGQGTLVTVSST

SEQ ID NO: 7755 - protein, 131 aa, Artificial Sequence
  Description of Artificial Sequence: Synthetic polypeptide
EVQLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGRGTLVTVSS

SEQ ID NO: 7756 - protein, 119 aa, Artificial Sequence
  Description of Artificial Sequence: Synthetic polypeptide
QSGAEVRKPGASVKVSCKASGYNFIAYYVHWVRQAPGQGLTWMGWINPDSGDTVYAQNFLDRVTMTRNTSITTVYLELKDLTLADTAIYYCATPDKKDDLGWFDTWGQGSQVTVSSAST

SEQ ID NO: 7757 - protein, 122 aa, Artificial Sequence
  Description of Artificial Sequence: Synthetic polypeptide
QSGAEVKKPGASVKVSCKASGYTFTVYYMHWVRQAPGRGLEWIGWVKAVSGAVNYGSLDFRHRVSLTRDRDLFTAHMDIRGLTQDDTATYFCARQKFARGDQGWFFDLWGRGTLIVVSSAST

SEQ ID NO: 7758 - protein, 130 aa, Artificial Sequence
  Description of Artificial Sequence: Synthetic polypeptide
QSGSGVKKPGASVRVSCRASEDLFGDEIIYDDEVIHWLRQVPGQRPEWMGWIRPKTGARNQARQFQPRISLTRDRALSTAYLDLNKTSADSGTYFCARQTFKPDFYFADQGWSFNLWGRGAHFIVSSAST

SEQ ID NO: 7759 - protein, 236 aa, Artificial Sequence
  Description of Artificial Sequence: Synthetic polypeptide
EVQLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 7760 - protein, 122 aa, Artificial Sequence
  Description of Artificial Sequence: Synthetic polypeptide
QSGAEVKKPGSSVKVSCKVSGGVFTSYAVTWVRQAPGQGLEWIGWVKAVSGAVNYGSLDFRHRVSLTRDRDLFTAHMDIRGLTQDDTAIYFCARQKFARGDQGWFFDLWGRGTLIVVSSAST

SEQ ID NO: 7761 - protein, 129 aa, Artificial Sequence
  Description of Artificial Sequence: Synthetic polypeptide
AGRGGVKKPGASVTLSCKTADEDVFDAAYMHWVRQAPGQTFEWLGWMKPVTGAVNYARKFQGRVSFYRTRELGIAYMDLRNLRFDDTAVYYCARAGVWFGELLPHWSGVGGGMDVWGQGTTVTVSSAST

SEQ ID NO: 7762 - protein, 125 aa, Artificial Sequence
  Description of Artificial Sequence: Synthetic polypeptide
QSGAEVKKPGASVKVSCKASGYTFTSYGISWVRQAPGRGLEWIGWNKTVSGAVNFGSVDFRDRVSLTRDRDLFTAHMDIRGLTQGDTATYFCARQKFEKLYSDDQGLYFDLWGRGTLIIVSSAST

SEQ ID NO: 7763 - protein, 117 aa, Artificial Sequence
  Description of Artificial Sequence: Synthetic polypeptide
QSGPEVRKPGASVTVSCKTSGYTFTDNYFHWLRQAPGMGLEWMGWINPHNGGIKSAKKFQGRITMTRDTTIDTAYMELSGLTSDDTAFYFCAREGGHSSGFDYWGQGALVTVTSAST

SEQ ID NO: 7764 - protein, 121 aa, Artificial Sequence
  Description of Artificial Sequence: Synthetic polypeptide
QSGAEVKKPGASVKVSCKASGYTFTTYGISWVRQAPGQGLFWIGWMKTVTGAVNFGHQISDRVSLTRDRDLFTAHMDIRGLTQGDTATYFCARQKFYAGGQGWYFDLWGRGTLIVVSSAST

SEQ ID NO: 7765 - protein, 127 aa, Artificial Sequence
  Description of Artificial Sequence: Synthetic polypeptide
SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHPWGQGTQVIVSPASTKG

SEQ ID NO: 7766 - protein, 127 aa, Artificial Sequence
  Description of Artificial Sequence: Synthetic polypeptide
SQQLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDPWGQGTLVIVSAASTKG

SEQ ID NO: 7767 - protein, 127 aa, Artificial Sequence
  Description of Artificial Sequence: Synthetic polypeptide
SQQLVQSGTQVKKPGASVRISCQASGYSFTDYVLHWYRQAPGQGLEWMGWIKPVYGARNYARRFQGRINFDRDIYREIAFMDLSGLRSDDTALYFCARDGSGDDTSWYLDPWGQGTLVIVSAASTKG

SEQ ID NO: 7768 - protein, 127 aa, Artificial Sequence
  Description of Artificial Sequence: Synthetic polypeptide
SQQLVQSGTQVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLHPWGQGTLVIVSAASTKG

SEQ ID NO: 7769 - protein, 127 aa, Artificial Sequence
  Description of Artificial Sequence: Synthetic polypeptide
SQQLVQSGTQVKKPGASVRVSCQASGYTFMNYIIHWWRQAPGQRLEWMGWINPVFGARNYAHRFQGRINFDRDINRETFQMELTGLRSDDTAVYYCARDGSGDARDWHLDPWGQGTLVIVSSASTKG

SEQ ID NO: 7770 - protein, 127 aa, Artificial Sequence
  Description of Artificial Sequence: Synthetic polypeptide
SQHLVQSGTQVKKPGASVRVSCQASGYTFTNYILHWWRQAPGQGLEWMGLIKPVFGAVNYARQFQGRIQLTRDINREIAFLDLSGLRSDDTAVYYCARDESGDDLKWHLHPWGQGTQVIVSPASTKG

SEQ ID NO: 7771 - protein, 127 aa, Artificial Sequence
  Description of Artificial Sequence: Synthetic polypeptide
SQQLVQSGTQVKKPGASVRVSCQASGYTFMNYIIHWWRQAPGQRLEWMGWINPVFGARNYAHRFQGRINFDRDINRETFQMDLTGLRSDDTAVYYCARDGSGDARDWHLHPWGQGTLVIVSSASTKG

SEQ ID NO: 7772 - protein, 225 aa, Artificial Sequence
  Description of Artificial Sequence: Synthetic polypeptide
SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHPWGQGTQVIVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7773 - protein, 127 aa, Artificial Sequence; identical to SEQ ID NO: 7765
  Description of Artificial Sequence: Synthetic polypeptide

SEQ ID NO: 7774 - protein, 127 aa, Artificial Sequence
  Description of Artificial Sequence: Synthetic polypeptide
SQQLVQSGTQVKKTGASVRVSCQASGYDFTKYLIHWWRQAPGQGLEWMGWMKPVYGATNYAHRFQGRISFTRDIYREIAFMDLNGLRSDDTAVYFCARDGGGDDRTWLLDAWGQGTLVIVSSASTKG

SEQ ID NO: 7775 - protein, 127 aa, Artificial Sequence; identical to SEQ ID NO: 7770
  Description of Artificial Sequence: Synthetic polypeptide

SEQ ID NO: 7776 - protein, 127 aa, Artificial Sequence
  Description of Artificial Sequence: Synthetic polypeptide
SQQLVQSGTQVKKPGASVRISCQASGYTFTDYVLHWWRQAPGQGLEWMGWIKPVYGARNYARRFQGRINFDRDIYREIAFLDLSGLRSDDTARYFCARDGSGDDTSWHLHPWGQGTLVIVSAASTKG

SEQ ID NO: 7777 - protein, 127 aa, Artificial Sequence; identical to SEQ ID NO: 7768
  Description of Artificial Sequence: Synthetic polypeptide

SEQ ID NO: 7778 - protein, 127 aa, Artificial Sequence; identical to SEQ ID NO: 7768
  Description of Artificial Sequence: Synthetic polypeptide

SEQ ID NO: 7779 - protein, 127 aa, Artificial Sequence; identical to SEQ ID NO: 7774
  Description of Artificial Sequence: Synthetic polypeptide

SEQ ID NO: 7780 - protein, 126 aa, Artificial Sequence
  Description of Artificial Sequence: Synthetic polypeptide
SQQLVQSGAQVKKPGASVRVSCQASGYTFTNHFLHWWRQAPRQGLEWMGWINPVHGGRNYARRFQGRINFGRDVYQETAYMELSGLRNDDTATYFCARGGGDGRNWHLHPWGQGTLVIVSAASTKG

SEQ ID NO: 7781 - protein, 127 aa, Artificial Sequence; identical to SEQ ID NO: 7765
  Description of Artificial Sequence: Synthetic polypeptide

SEQ ID NO: 7782 - protein, 127 aa, Artificial Sequence
  Description of Artificial Sequence: Synthetic polypeptide
SQQLVQSGAQVKKPGASLRVSCQASGYTFMNYLLHWWRQAPGQGLEWMGWINPVYGAVNYAHRFQGRLTFSRDVYREIAYMDLNGLRSDDTAVYFCARDGSGDDRNWHLDPWGQGTLVIVSSASTKG

SEQ ID NO: 7783 - protein, 127 aa, Artificial Sequence
  Description of Artificial Sequence: Synthetic polypeptide
SQQLVQSGTQVKKPGASVRVSCQASGYTFTNYILHWWRQAPGRGLEWMGLIKPVYGAVNYARQFQGRIQLTRDIYREIAFLDLSGLRPDDTAVYYCARDESGYDLNWHLDSWGQGTQVIVSPASTKG

SEQ ID NO: 7784 - protein, 127 aa, Artificial Sequence
  Description of Artificial Sequence: Synthetic polypeptide
SQQLVQSGTQVKKPGASVRVSCQASGYTFTDYVLHWWRQAPGQGLEWMGWIKPVYGARNYAHRFQGRINFDRDVYREIAYMDLSGLRSDDTAVYFCARDGSGDATSWHLHPWGQGTLVIVSSASTKG

SEQ ID NO: 7785 - protein, 127 aa, Artificial Sequence; identical to SEQ ID NO: 7769
  Description of Artificial Sequence: Synthetic polypeptide

SEQ ID NO: 7786 - protein, 137 aa, Artificial Sequence
  Description of Artificial Sequence: Synthetic polypeptide
QVTLVQSGAEVKKPGASVRISCRASGFTFDDYSDYSFIPTTYLIHWFRQAPGQGLEWMAWINSVNGGRNIARQFQGRVTVARDRSNSIAFLEFSGLRHDDTAVYFCARDRRDDDRAWLLDPWGQGTRVTVSSASTKG

SEQ ID NO: 7787 - protein, 125 aa, Artificial Sequence
  Description of Artificial Sequence: Synthetic polypeptide
SRGAEVKKPGASVKVSCKASGYTFTGYYIHWVRQAPGQGLEWIGWVKIVSGTVNFASLDFRNRISLSRDRDLSTAYMDIRGLTQDDTATYFCARQKFASRYSGDQGSYFDLWGRGTLIVVSSAST

SEQ ID NO: 7788 - protein, 125 aa, Artificial Sequence
  Description of Artificial Sequence: Synthetic polypeptide
QSGSGVKKLGASVRVSCWTSEDIFERTELIHWVRQAPGQGLEWIGWVKAVTFTVNFGSLNFRQRVSLTRDRDLFTAHMDIRGLTQGDTATYFCARQKFEKYTGGQGWYFDLWGRGTLIVVSSAST

SEQ ID NO: 7789 - protein, 125 aa, Artificial Sequence
  Description of Artificial Sequence: Synthetic polypeptide
QSEAEVKKPGASMTVSCETADEDIFDAAYMHWVRQAPGQTFEWLGWMKPVTGAVNYARKFQGRISFYRTRELAIAYMDLRDLRFDDTAVYFCARKTAGDVSGDNRGYFFDLWGRGSRVIVSSAST

SEQ ID NO: 7790 - protein, 126 aa, Artificial Sequence
  Description of Artificial Sequence: Synthetic polypeptide
QIAGGGVKKPGASVTLSCKTADEDVFDAAYMHWVRQAPGQTFEWLGWMKPVTGAVSYARKFQGRVSFYMTRELGMAYMDLRNLRFDDTAVYYCARVGGAADDSGVTEPPSDYWGQGTLVTVSSAST

SEQ ID NO: 7791 - protein, 123 aa, Artificial Sequence
  Description of Artificial Sequence: Synthetic polypeptide
QSGSGVKKVGASVRVSCWTSEDIFERTELIHWVRQAPGQGLEWIGWVKAVSGAVNYGSLDFRHRVSLTRDRDLFTAHMDIRGLTQDDTAIYFCARQKFYAGGQGWYFDLWGRGTLIVVSSAST

SEQ ID NO: 7792 - protein, 121 aa, Artificial Sequence
  Description of Artificial Sequence: Synthetic polypeptide
QSGAEMKKPGSSVKVSKASGGTFRHSPISWVRQAPGQGLEWIGWVKAVSGAVNYGSLDFRHRVSLTRDRDLSTAHMDIRGLTQDDTATYFCARQKFARGDQGWFFDLWGRGTLIVVSSAST

SEQ ID NO: 7793 - protein, 126 aa, Artificial Sequence
  Description of Artificial Sequence: Synthetic polypeptide
PSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSAST

SEQ ID NO: 7794 - protein, 127 aa, Artificial Sequence
  Description of Artificial Sequence: Synthetic polypeptide
QSGSAMKKPGASVRVSCWTSEDIFDTTELIYWVRQAPGQGLEWIGWVKIVSGTVNFASLDFRNRISLSRDRDLSTAYMDIRGLTQDDTALYYCAREWRVCTGGSPCPSEYLQHWGQGTLVKVSLAST

SEQ ID NO: 7795 - protein, 126 aa, Artificial Sequence
  Description of Artificial Sequence: Synthetic polypeptide
QSASGVRRPGASVRVSCWTSEDIFERSELIYWVRQAPGRGLEWIGWIKLVSGAVNFGSVDFRDRVSLTRDRDLFTAHMDIRGLTQDDTATYFCARQKFASRYSGDQGSYFDLWGRGTLIIVSSAST

SEQ ID NO: 7796 - protein, 124 aa, Artificial Sequence
  Description of Artificial Sequence: Synthetic polypeptide
QSGAAVKKPGSSVKVSCKASGYIFTGYYIHWIRQAPGQGLEWMGWINPSTGDTKFARQFQGRVSFYRTRELGIAYMDLRDLKFDDTAVYFCARKTKGDVSGDDRGFFFDLWGRGTRVIVSSAST

SEQ ID NO: 7797 - protein, 123 aa, Artificial Sequence
  Description of Artificial Sequence: Synthetic polypeptide
QSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKFMSGGQGWYFDLWGRGTVIVVSSAST

SEQ ID NO: 7798 - protein, 124 aa, Artificial Sequence
  Description of Artificial Sequence: Synthetic polypeptide
QSGAEVKKPGASVKVSCKASGYTFTGYYMHWVRQAPGQTFEWLGWMKPVTGAVNYARQFQGRVSFYRTRELGIAYMDLRDLKFDDTAVYFCARKTKADVSGDDRGFFFDLWGRGTRVIVSSAST

SEQ ID NO: 7799 - protein, 125 aa, Artificial Sequence
  Description of Artificial Sequence: Synthetic polypeptide
QAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSAST

SEQ ID NO: 7800 - protein, 122 aa, Artificial Sequence
  Description of Artificial Sequence: Synthetic polypeptide
QSGSGVKKPGTSVRVSCWTSEDIFERTELIHWVRQAPGQGLEWIGWVKTVTGAVNFGSPNFRHRVSLTRDRDLFTAHMDIRGLTQGDTATYYCARDWGATVVVYLLDSWGQGTPVTVSSAST

SEQ ID NO: 7801 - protein, 126 aa, Artificial Sequence
  Description of Artificial Sequence: Synthetic polypeptide
QSGSTQMKKPGASVRVPCWTSEDIFDTTELIYWVRQAPGQGLEWIGRVKIVSGTVNFASLDFRNRISLSRDRDLSTAHMDIRGLTQDDTATYFCARQKFESRYGDQGSYFDLWGRGTLIIVSSAST

SEQ ID NO: 7802 - protein, 126 aa, Artificial Sequence
  Description of Artificial Sequence: Synthetic polypeptide
QSGAEVKKPGASVRVSCWTSEDIFDTTELIYWVRQAPGQGLEWIGWVKIVSGTVNFASLDFRNRISLSRDRDLSTAHMDIRGLTQDDTATYFCARQKFESRYTGGQGWYFDLWGRGTHIVVSSAST

SEQ ID NO: 7803 - protein, 125 aa, Artificial Sequence
  Description of Artificial Sequence: Synthetic polypeptide
QSGSATEKPGASVRVSCWTSEDIFDTTELNWVRQAPGQGLEWIGWVKIVSGTVNFGSSDFRNRISLSRDRDLSTAHMDIRGLTQDDTATYFCARQKFESRYRGDQGSYFDLWGRGTLIIVSSAST

SEQ ID NO: 7804 - protein, 125 aa, Artificial Sequence
  Description of Artificial Sequence: Synthetic polypeptide
QSGAEVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSAST

SEQ ID NO: 7805 - protein, 125 aa, Artificial Sequence
  Description of Artificial Sequence: Synthetic polypeptide
QSGSAMKKPGASVRCSCWTSEDIFDTTELIYWVRQAPGQGLEWIGWVKIVSGTVNFARQFQGRVSFYRTRELGIAYMDLRDLKFDDTAVYFCARKTKGDVSGDDRGFFFDLWGRGTRVIVSSAST

SEQ ID NO: 7806 - protein, 117 aa, Artificial Sequence
  Description of Artificial Sequence: Synthetic polypeptide
ESGPEVRKPGASVKISCKTSGYIFTDNYFHWLRQAPAVGLEWMGWINPHNGYTKSAKKFQGRITMTRDTAVDTAYMELIDLTSDDTAIYFCAREGGHSSGFDYWGQGALVTVTSAST

SEQ ID NO: 7807 - protein, 229 aa, Artificial Sequence
  Description of Artificial Sequence: Synthetic polypeptide
QVQLLESGAEVKKPGSSVKVSCKASGDTFIRYSFTWVRQAPGQGLEWMGRIITILDVAHYAPHLQGRVTITADKSTSTVYLELRNLRSDDTAVYFCAGVYEGEADEGEYRNNGFLKHWGQGTLVTVTSASTKGPSVFPLAPSSKSTSGGTAALGCLVKDYFPQPVTVSWNSGALTSGVHTFPAVLQSSGLYSLSSVVTVPSSSLGTQTYICNVNHKPSNTKVDKKVEPK

SEQ ID NO: 7808 - protein, 126 aa, Artificial Sequence
  Description of Artificial Sequence: Synthetic polypeptide
QSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSAST

SEQ ID NO: 7809 - protein, 127 aa, Artificial Sequence
  Description of Artificial Sequence: Synthetic polypeptide
QSGSAMKKPGRSVKYSCWTSEDIFTFTHRVDLWVRQAPGQGLEWIGWVKIVSGTVNFASLDFRNRISLSRDRDLSTAYMDIRGLTQDDTATVFCARQKFASRYSGDQGSYFDLWGRGTLIVVSSAST

SEQ ID NO: 7810 - protein, 125 aa, Artificial Sequence
  Description of Artificial Sequence: Synthetic polypeptide
QSGSGVKKPGASVRVSCWTSEDIFEKSELIHWVRQAPGQGLEWMGWINPRTGVANNAQKFQDRVTMTRDTSITTAYMELTNLRSDDSATYYCALGDLICKTRTCSYNSFEPWGQGTLITVSSAST

SEQ ID NO: 7811 - protein, 125 aa, Artificial Sequence
  Description of Artificial Sequence: Synthetic polypeptide
QAGGGMKKPGASMTVSCKTADEDIFDAAYMHWVRQAPGQTFEWLGWMKPVTGAVNYARRFQGRVSFYRTRELGIAYMDLRDLKFDDTAVYFCARKTKGDVSGDDRGFVSDLWGRGTRVIVSSAST

SEQ ID NO: 7812 - protein, 122 aa, Artificial Sequence
  Description of Artificial Sequence: Synthetic polypeptide
QSGAEVKKPGASVKVSCKASGYTFTGYYMHWVRQAPGQGLEWIGWVKTVSGAVNFGSLNFRHRVSLTRDRDLFTAHMDIRGLTQGDTATYFCARQKFARGDQGWFFDLWGRGTLIVVSSAST

SEQ ID NO: 7813 - protein, 126 aa, Artificial Sequence
  Description of Artificial Sequence: Synthetic polypeptide
QSGAEVKKPGSSVRVSCWTSEDIFERTELIHWVRQAPGQGLEWIGWVKTVTGAVNFGSPNFRHRVSLTRDRDLFTAHMDIRGLTQGDTATYFCARQKFESRYSGDQGSYFDLWGRGTLIIVSSAST

SEQ ID NO: 7814 - protein, 126 aa, Artificial Sequence
  Description of Artificial Sequence: Synthetic polypeptide
NTGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSAST

SEQ ID NO: 7815 - protein, 124 aa, Artificial Sequence
  Description of Artificial Sequence: Synthetic polypeptide
QAGGMKKPGASMTVSCETADEDIFDAAYMHWVRQVPGQTFEWLGWMKPVTGAVNYARKFQGRISFYRTRFLAIAYMDLRDLRFDDTAVYFCARKTVGDVSGDGRGFFFDLWGRGTRVIISSAST

SEQ ID NO: 7816 - protein, 127 aa, Artificial Sequence
  Description of Artificial Sequence: Synthetic polypeptide
QSGSAMKKPGASVRVSCWTSEDIFDTTELIYWVRQAPGQGLEWIGWVKIVSGTVNFASSDFRNRISLSRDRDLSTAHMDIRGLTQDDTATYFCARQKFERVRYRGDQGSYFDLWGRGTVIISSSAST

SEQ ID NO: 7817 - protein, 122 aa, Artificial Sequence
  Description of Artificial Sequence: Synthetic polypeptide
QVRDEVKKPGSSMKVSCTASRGTFSSYAISWVRQAPGQGLEWIGWVKTVTGAVNFQSAYFRHRVSLTRDRDLFTAHMDIRGLTQGDTATYFCARQKFYKGGQGWYFDLWGRGTLIVVSSAST

SEQ ID NO: 7818 - protein, 122 aa, Artificial Sequence
  Description of Artificial Sequence: Synthetic polypeptide
QSGAEVKKPGASVKVSCKASGYTFTSYYMHWVRQAPGQGLEWIGWVKPVTGAVNFGSPNFRHRVSLTRDRDLFTAHMDIRGLTQGDTATYFCARQKYYAGGQGWYFDLWGRGTLIVVSSAST

SEQ ID NO: 7819 - protein, 123 aa, Artificial Sequence
  Description of Artificial Sequence: Synthetic polypeptide
QSGSGVKKLGASVRVSCWTSEDIFERTELIHWVRQAPGQGLEWIGWVKSCQCAVNYGSLDFRQSLSLTRDRDLSTAHMDIRGLTQDDTATYFCARQKFCEGHQGWFFDLWGRGTLIVVSSAST

SEQ ID NO: 7820 - protein, 227 aa, Artificial Sequence
  Description of Artificial Sequence: Synthetic polypeptide
QVQLEQSGTAVRKPGASVTLSCQASGYNFVKYIIHWVRQKPGLGFEWVGMIDPYRGRPWSAHKFQGRLSLSRDTSMEILYMTLTSLKSDDTATYFCARAEAASDSHSRPIMFDHWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 7821 - protein, 121 aa, Artificial Sequence
  Description of Artificial Sequence: Synthetic polypeptide
QVTLKESGPGILQPSQTLSLTCSFSGFSLSTSFMGVSWIRQPSGKGLEWLAHIYWDDDKRYNPSLKSRLTISKDTSSNQDFLKITSVDTRDTATYYCARRVSLTAYAMDYWGQGTSVTVSS

SEQ ID NO: 7822 - protein, 128 aa, Artificial Sequence
  Description of Artificial Sequence: Synthetic polypeptide
QVRLVQSGAQLKKPGASVTVSCEASGYNFVNYIINWVRQTPGRSFEWVGMIDPRRGRPWSAQKFQGRLTLTRDIDSEKLYMHLSGLRGDDTAVYYCARQDSDFHDGHGHTLRGMFDSWGQGSLITVSS

SEQ ID NO: 7823 - protein, 220 aa, Artificial Sequence
  Description of Artificial Sequence: Synthetic polypeptide
  MOD_RES (30)..(30): Any amino acid
QVQLQQWGAGLLKPSETLSLTCGVYGESLXGHYWSWVRQPPGKRLEWIGEIKHNGSPNYHPSLKSRVTISLDMSKNQFSLNLTSVTAADTAVYFCARRSNWPYLPFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 7824 - protein, 125 aa, Artificial Sequence
  Description of Artificial Sequence: Synthetic polypeptide
QSGGGVKKPGTSASFSCRTSDDIYDNEFFDSAFMHWVRLIPGQRPEWMGWMNPRSGAVNYARQLQPRVSMYRDRDLSTAYMEFKSLTSADTGTYFCARKKRGDGFNLYFDLWGRGSQVIVSSAST

SEQ ID NO: 7825 - protein, 125 aa, Artificial Sequence
  Description of Artificial Sequence: Synthetic polypeptide
QSGAEVKKPGSSIKVSCKASGDTISRYAINWVRQAPGQGLEWIGWVKTVTGAVNFGSLDFRHRISLTRDRDLFTAHMGIRGLTQGDTATYFCARQKFESRYTGGQGWYFDLWGRGTHIVVSSAST

SEQ ID NO: 7826 - protein, 462 aa, Artificial Sequence
  Description of Artificial Sequence: Synthetic polypeptide
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLFGVPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7827 - protein, 462 aa, Artificial Sequence
  Description of Artificial Sequence: Synthetic polypeptide
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLWGVPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7828 - protein, 462 aa, Artificial Sequence
  Description of Artificial Sequence: Synthetic polypeptide
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTWFGVPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7829 - protein, 462 aa, Artificial Sequence
  Description of Artificial Sequence: Synthetic polypeptide
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTWFGWPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7830 - protein, 462 aa, Artificial Sequence
  Description of Artificial Sequence: Synthetic polypeptide
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLFGWPIARGPVNAMDVWGQGITVTISSTSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 7831 - protein, 120 aa, Artificial Sequence
  Description of Artificial Sequence: Synthetic polypeptide
QSGAEVKKPGASAKVSCKASGYTFSGYHIHWVRQAPGQGLEWVGWINPNSGATQCAKKFQERVAMTRDTTNNTVYVELNRLTSDDTATYYCARDWGATVVVYLLDSWGQGTPVTVSSAST

SEQ ID NO: 7832 - protein, 137 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSWGQGTLISVSAASTKG

SEQ ID NO: 7833 - protein, 137 aa, Artificial Sequence
  Description of Artificial Sequence: Synthetic polypeptide
QIHLVQSGTEVRKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKG

SEQ ID NO: 7834 - protein, 122 aa, Artificial Sequence
  Description of Artificial Sequence: Synthetic polypeptide
QSGAEVKKPGASVKVSCKASGYTFTTYGISWVRQAPGQGLEWIGWVKTVTGAVNFGSSDFRQRVSLTRDRDLFTAHMDIRGLTQGDTATYFCARQKFYAGGQGWYFDLWGRGTLIVVSSAST

SEQ ID NO: 7835 - protein, 137 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVIISAVDLTGSSPPISSLEIKNLTSDDTAVYFCTTTSTSDYWSGLHHDGVMAFSSWGQGTLISVSAASTKG

SEQ ID NO: 7836 - protein, 87 aa, Artificial Sequence
  Description of Artificial Sequence: Synthetic polypeptide
QIWRWKSSASHHFRGRVLISAVDLTGSSPPISSLEIKNLTSDDTAVYFCTTTSTYDRWSGLHHDGVMAFSSWGQGTLISVSAASTKG

SEQ ID NO: 7837 - protein, 137 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDRWSGLHHDGVMAFSSWGQGTLISVSAASTKG

SEQ ID NO: 7838 - protein, 129 aa, Artificial Sequence
  Description of Artificial Sequence: Synthetic polypeptide
  MOD_RES (19)..(19): Any amino acid
  MOD_RES (90)..(90): Any amino acid
EVQLLESGGGLVRPGGSLXLSCSASGFTFNSYAMSWVRQAPGKGLEWVSSVSASGEMTYYADSVRGRFTISRDNANNALHLQMNSLRAEXTAVYYCAKVGGTVWSGYSNYLDYWGPGTLVTVSSASTKG

SEQ ID NO: 7839 - protein, 125 aa, Artificial Sequence
  Description of Artificial Sequence: Synthetic polypeptide
QVQLVQSGAEVKKPGASVKVSCKPSSNTFTSHYIHWVRQAPGQGLEWMGMINPGGSTRYAPKFQGRVTLTRDTSTRTVYMELSSLRSEDTAVYYCARPQYNLGRDPLDVWGLGTMVTVSSASTKG

SEQ ID NO: 7840 - protein, 124 aa, Artificial Sequence
  Description of Artificial Sequence: Synthetic polypeptide
EVQLVESGGGLVKPGGSLRLSCADSGFTFRSYSMHWVRQAPGKGLAWVSSISSTSNYIYYADSVKGRFTISRDNAKNSLYLQMNSLRAEDTAVYYCARTFITASWFDSWGQGTLVTVSSASTKG

SEQ ID NO: 7841 - protein, 104 aa, Artificial Sequence
  Description of Artificial Sequence: Synthetic polypeptide
VSGGRFSNYGLSWVRQAPGQGLEWMGRIVPAINRAKYAQKFQGRVILTADKITDTAYMELRSLRSEDTAIFYCARDPQIEIRGNAFDIWGQGTVVTVSSASTKG

SEQ ID NO: 7842 - protein, 128 aa, Artificial Sequence
  Description of Artificial Sequence: Synthetic polypeptide
QVQLQESGPGLVKPSGTLSLTCNVYGGSMISYYWSWIRQPPGKGLEWIGHVYNSGNTKYSPSLKNRVTISMDTSRNLFSLKVTSVTPADTAVYYCARADYDNIWDSRGGFDLWGQGTLVTVSSASTKG

SEQ ID NO: 7843 - protein, 130 aa, Artificial Sequence
  Description of Artificial Sequence: Synthetic polypeptide
QVQLVQLLQSGAEVKKPGSSVKVSCQISGYGFSNYAISWVRQAPGQGLEWLGRIVPAVGMTEYAQKFQGRVTFTADRSTITAYMDLRGLRSDDTAVYYCVRDPQVEVRGNAFDIWGQGTMVTVSSASTKG

SEQ ID NO: 7844 - protein, 126 aa, Artificial Sequence
  Description of Artificial Sequence: Synthetic polypeptide
QVQLVQSGAEMKKPGASVKVSCKASGHTFTNYYMHWVRQAPGQGLEWMGMINPTGDSTRYAQRFQGRVTMTRDTSTRTVYMELSSLRSDDTAVYYCARAHHDFWRAPVDVWGKGTTVTVSSASTKG

SEQ ID NO: 7845 - protein, 130 aa, Artificial Sequence
  Description of Artificial Sequence: Synthetic polypeptide
EVQLVQSGAEVKKPGESLRISCKTSGYNFNDDWIAWVRQRPDKGPEWMGIFYPGDSQATYSPSFQGHVTFSADTSISTAYLQWTSLKASDTAIYYCARTRCFGANCFNFMDVWGKGTALTVTVSSASTKG

SEQ ID NO: 7846 - protein, 125 aa, Artificial Sequence
  Description of Artificial Sequence: Synthetic polypeptide
QVQLQESGPGPVKPSETLSLTCTVSGGSMISYYWSWIRQPPGKGLEWIGYIFTNGRTTYSPSLRSRVTISLDTSTNHFSLRLKSVTAADTAIYYCARLDGEAFRYYLDLWGQGNLVTVSSASTKG

SEQ ID NO: 7847 - protein, 99 aa, Artificial Sequence
  Description of Artificial Sequence: Synthetic polypeptide
IRSFYWHWIRQSPGKGLEWLGSVFDNGLTTHNPSLKSRLTISEDPSRNQISLKLRSMTAADTAVYYCARGDYDILTSSYQFDYWGQGTLVAVSSASTKG

SEQ ID NO: 7848 - protein, 127 aa, Artificial Sequence
  Description of Artificial Sequence: Synthetic polypeptide
QVQLQESGPGLVKPSETLSLTCTVFGASIRSFYWHWIRQSPGKGLEWLGSVFDNGLTTYNPSLKNRLSISEDPSRNQISLNLRSMTAADTAVYYCARADYDLLTSSYHFDSWGQGTLVTVSSASTKG

SEQ ID NO: 7849 - protein, 125 aa, Artificial Sequence
  Description of Artificial Sequence: Synthetic polypeptide
QVQLQESGPGLVKPSETLSLTCTVSGGSISYYYWSWIRQPPGKGLEWIGDIYYSGTTDYNPSLKSRVTISVDTSKNQFSLKLSSVTAADTAVYYCARRRGQRLLAYFDYWGQGSLVTVSSASTKG

SEQ ID NO: 7850 - protein, 127 aa, Artificial Sequence
  Description of Artificial Sequence: Synthetic polypeptide
QVQLVQSGAEVKKPGASVKVSCKAPGYTFIGHYMHWIRQAPGQGLEWMGWINPNSGDTNYAQTFQGRVTMTRDTSISTAYMELTRLRSDDTAVYYCARDLRPMRGNWAMHVWGEGTTVTVSSASTKG

SEQ ID NO: 7851 - protein, 106 aa, Artificial Sequence
  Description of Artificial Sequence: Synthetic polypeptide
CTVSGGSISSAGYYWTWIRQHPGKGLEFIGYIYYIGTTYYNPSLKSRLTISIDTSKNQFSLKLSSVTAADTAIYYCARDYTARGRHFFDYWGQGALVTVSSASTKG

SEQ ID NO: 7852 - protein, 98 aa, Artificial Sequence
  Description of Artificial Sequence: Synthetic polypeptide
SSFAISWVRQAPGQGLEWMGGIIPIFEATSYAQKFQDRLTITTDESTTTAYMDLSSLRSEDTAVYYCARAQGDILTEGYFDYWGQGTLVTVSSASTKG

SEQ ID NO: 7853 - protein, 125 aa, Artificial Sequence
  Description of Artificial Sequence: Synthetic polypeptide
QVQLVQSGAEVKKPGSSVKVSCKVSFFSNYGISWVRQRPGQGLEWMGRIIPAIDDMTYAQTFRGRVTFSADKFTTTAYMELTGLTFEDTATYFCARDPQVNRRGNCFDHWGQGTLVTVSSASTKG

SEQ ID NO: 7854 - protein, 83 aa, Artificial Sequence
  Description of Artificial Sequence: Synthetic polypeptide
LEWMGRIIPAIDDVTYAQTFRGRVTFSADKFTTTAYMDLTGLRSEDTATYFCARDPQVNRRGNCFDHWGQGTLVTVSSASTKG

SEQ ID NO: 7855 - protein, 125 aa, Artificial Sequence
  Description of Artificial Sequence: Synthetic polypeptide
  MOD_RES (18)..(18): Any amino acid
QVQLQESGPGLVKPSETXSLTCSVSNGSISSGGYYWSWLRQFPGKGLEWIGSIHYTGRTMYNPSLMGRPALSMDTSNNQFSLKLSSVTAADTALYFCARDLQWIFVVDPWGQGTLVTVSSASTKG

SEQ ID NO: 7856 - protein, 126 aa, Artificial Sequence
  Description of Artificial Sequence: Synthetic polypeptide
QVQLVQSGAEVKKPGAAVKISCKASRFTFSSYYIHWVRQAPGQGLEWMGIINPSGGSTSNAQKFQDRVTLTRDMSTGTVYMELSRLTSEDTAVYYCATPEPSSIVAPLYYWGQGTLVTVSSASTKG

SEQ ID NO: 7857 - protein, 125 aa, Artificial Sequence
  Description of Artificial Sequence: Synthetic polypeptide
EVQLLESGGGLVQPGGSLRLSCAVSGFTFGGHAVSWVRQAPGKGLEWLSQISGTGSRTDYADAVKGRFTVSRDNSKKTVYLQMNSLRVEDTALFYCATRSPGGGYAFDIWGQGAMVTVSSASTKG

SEQ ID NO: 7858 - protein, 132 aa, Artificial Sequence
  Description of Artificial Sequence: Synthetic polypeptide
QVQLVQSGAEVKKPGSSVKVSCKASGGTFTTYDISWVRQAPGQGLEWMGGILPDFGAPSYAQKFQDRVTITTDESSSTAYMELNSLRSEDTAIYYCARGRGDDFWSGESPSWYFDYWGQGTLVTVSSASTKG

SEQ ID NO: 7859 - protein, 127 aa, Artificial Sequence
  Description of Artificial Sequence: Synthetic polypeptide
QVQLQESGPGLVKPSETLSLTCTVSGGSISSAGYYWSWIRQHPEKGLEFIGYIYYLGTTYYNPSLKSRVSISIDTSNNQFSLELSSVSAADTAIYYCARDYTASGRHFFDYWGQGTLVTVSSASTKG

SEQ ID NO: 7860 - protein, 124 aa, Artificial Sequence
  Description of Artificial Sequence: Synthetic polypeptide
EVQLLESGGALVQPGGSLRLSCAASGFTFSTSSMSWVRQAPGKGLEWVSAIGSGRGSTFYADSVKGRFTISRDNSKNTLSLQMNSLTAEDTATYYCTKTGGLLRFPEVWGKGTTVTVSSASTKG

SEQ ID NO: 7861 - protein, 127 aa, Artificial Sequence
  Description of Artificial Sequence: Synthetic polypeptide
QVQLVQSGAEVKKPGSSVKVSCKASGGTFSNYAISWVRQAPGQGLEWMGGIIPIFEAASYAQKFQDRLTITTDESTTTAYMDLSSLRSEDTAIYYCARAQGDILTEGYFDYWGQGTLVTVSSASTKG

SEQ ID NO: 7862 - protein, 126 aa, Artificial Sequence
  Description of Artificial Sequence: Synthetic polypeptide
QVQLQESGPGLVKPSETLSLTCTVSGGSISTYYWSWIRQPPGKGLEWIGYISYSGSTNYNPSLKSRVTISVDTSKNQFSLKLSSVTAADTAVYYCARHKSVLLWFRELDYWGQGTLVTVSSASTKG

SEQ ID NO: 7863 - protein, 126 aa, Artificial Sequence
  Description of Artificial Sequence: Synthetic polypeptide
QVQLVQSGAEVKKPGSSVKVSCKTSGVRFSSNAISWVRQAPGQGLEWMGRTTPMLGGANHAPSFKGRVTISADESTRTVYMEMSSLRYEDTAVYYCASGRREGLNFLLDYWGQGTLVTVSSASTKG

SEQ ID NO: 7864 - protein, 128 aa, Artificial Sequence
  Description of Artificial Sequence: Synthetic polypeptide
QVQLVQSGAEVRKPGASVKVSCKTSGYTFTNSYIHWVRQAPGQGLEWMGIINPPGGNTYYAQKFHGRVTLTRDTSTSTVYMELNSLRSEDTAVYFCARPHSPTNIPSRPLDYWGQGTLVTVSSASTKG

SEQ ID NO: 7865 - protein, 130 aa, Artificial Sequence
  Description of Artificial Sequence: Synthetic polypeptide
QVQLVQSGAEVKKPGASVKVSCKVSGYPLAELSVHWVRQVPGKGLEWVGGFDPEEGKTVYAQKFQGRVTMTEDRSTDTVYMELISLRYEDTAVYYCATDNPVLQLGELSSSLDYWGQGTLVTVSSASTKG

SEQ ID NO: 7866 - protein, 115 aa, Artificial Sequence
  Description of Artificial Sequence: Synthetic polypeptide
PSETLSLTCRVSGASISNFYWTWIRQPAGKGLEWIGRLYSSDKTNYNPSLNGRVTMSLDTSKNQFSLRLTSMTDADTAIYYCAREKGQWVTLPPYYFDSWGQGILVTVSSASTKG

SEQ ID NO: 7867 - protein, 99 aa, Artificial Sequence
  Description of Artificial Sequence: Synthetic polypeptide
NTFTSHYVHWVRQAPGQGLEWMGMINPGGTTRYAPKFQDRVTLTRDTSTRTVYMELRSLRSEDTAVYYCARPQYNLGREPLNVWGQGTMVTVSSASTKG

SEQ ID NO: 7868 - protein, 128 aa, Artificial Sequence
  Description of Artificial Sequence: Synthetic polypeptide
QVQLQESGPGLVKPSETLSLTCSVSGASISNFYWTWIRQPAGKGLEWVGRLYSSDRTNYNPSLNGRVTMSLDTSKNQFSLRLTSMTDADTAIYFCAREKGQWLTVPPYYFDSWGQGILVTVSSASTKG

SEQ ID NO: 7869 - protein, 104 aa, Artificial Sequence
  Description of Artificial Sequence: Synthetic polypeptide
CTVSGGSIISYYWNWIRQSPGKGLEWLGYIFDGGRANYNPSLRSRLTMSVDTSKNQISLKVKSVTAADSAIYYCARLDGEAFRYYFDSWGQGTLVTVSSASTKG

SEQ ID NO: 7870 - protein, 112 aa, Artificial Sequence
  Description of Artificial Sequence: Synthetic polypeptide
QTLSLTCSVSGGSISSAGYYWGWIRQHPGKGLEWIGHIYYSGNTNYNPSLKSRLSMSVETSKNQFSLNLASVTAADTAVYFCARDYSAAGRHLFDSWGQGILVTVSSASTKG

SEQ ID NO: 7871 - protein, 115 aa, Artificial Sequence
  Description of Artificial Sequence: Synthetic polypeptide
KPSQTLSLTCTVSGGSISSAGYYWTWIRHHPGKGLEFIGYIYHIGTPYYNPSLKSRLTISIDTSKNQFSLKLSSVTAADTAIYYCARDYTARGRHFFDYWGQGALVTVSSASTKG

SEQ ID NO: 7872 - protein, 128 aa, Artificial Sequence
  Description of Artificial Sequence: Synthetic polypeptide
QVQLVQSGADVKKPGATVTVSCKTDEDEDDFRAHLMQWMRQAPGQRLEWVGWIKPQTGQPSYGQKFQGRVTLTREVSTSTVFLQLRNLRSDDTAVYYCARPRGGRDNWSFHVWGRGTLVTVSSASTKG

SEQ ID NO: 7873 - protein, 128 aa, Artificial Sequence
  Description of Artificial Sequence: Synthetic polypeptide
QVQLVQSGADVKKPGASVTVSCKTDEDEDDFRAHLVQWMRQAPGQRLEWVGWIKPQTGQPSYAQKFQGRVTLTREVSTSTVFLQLRNLRSDDTAVYYCARPRGGRDNWSFHVWGRGTLVTVSSASTKG

SEQ ID NO: 7874 - protein, 128 aa, Artificial Sequence; identical to SEQ ID NO: 7873
  Description of Artificial Sequence: Synthetic polypeptide

SEQ ID NO: 7875 - protein, 126 aa, Artificial Sequence
  Description of Artificial Sequence: Synthetic polypeptide
QVQLVQSGAAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG

SEQ ID NO: 7876 - protein, 126 aa, Artificial Sequence; identical to SEQ ID NO: 7875
  Description of Artificial Sequence: Synthetic polypeptide

SEQ ID NO: 7877 - protein, 126 aa, Artificial Sequence; identical to SEQ ID NO: 7875
  Description of Artificial Sequence: Synthetic polypeptide

SEQ ID NO: 7878 - protein, 126 aa, Artificial Sequence
  Description of Artificial Sequence: Synthetic polypeptide
QVQLVQSGAAVKKPGASVKVSCETYGYKFTDHFMHWWRQAPGQGLEWMGWINPYSSAVSYSPRYQGRVTMTRDTFLETVYMELRGLRFDDTAIYYCATPKSGRDYWSFDLWGQGTLVTVSSASTKG

SEQ ID NO: 7879 - protein, 126 aa, Artificial Sequence; identical to SEQ ID NO: 7878
  Description of Artificial Sequence: Synthetic polypeptide

SEQ ID NO: 7880 - protein, 126 aa, Artificial Sequence; identical to SEQ ID NO: 7878
  Description of Artificial Sequence: Synthetic polypeptide

SEQ ID NO: 7881 - protein, 126 aa, Artificial Sequence; identical to SEQ ID NO: 7875
  Description of Artificial Sequence: Synthetic polypeptide

SEQ ID NO: 7882 - protein, 126 aa, Artificial Sequence
  Description of Artificial Sequence: Synthetic polypeptide
QVQLVQSGAAVKKPGASVKVSCEAYGYKFTDHFMHWWRQAPGQGLEWMGWINPYTSAVNYSPKYQGRVTMTRDTFLETVYMELRGLRVDDTAIYYCATPKSGRDYWSFDLWGQGTLVTVSSASTKG

SEQ ID NO: 7883 - protein, 126 aa, Artificial Sequence; identical to SEQ ID NO: 7882
  Description of Artificial Sequence: Synthetic polypeptide

SEQ ID NO: 7884 - protein, 126 aa, Artificial Sequence
  Description of Artificial Sequence: Synthetic polypeptide
QVQLVQSGGAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG

SEQ ID NO: 7885 - protein, 128 aa, Artificial Sequence; identical to SEQ ID NO: 7873
  Description of Artificial Sequence: Synthetic polypeptide

SEQ ID NO: 7886 - protein, 128 aa, Artificial Sequence; identical to SEQ ID NO: 7873
  Description of Artificial Sequence: Synthetic polypeptide

SEQ ID NO: 7887 - protein, 128 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVIVSSASTKG

SEQ ID NO: 7888 - protein, 125 aa, Artificial Sequence
  Description of Artificial Sequence: Synthetic polypeptide
QVQLQESGPGLVKPSETLSLTCSVSNGSISSGGYYWSWLRQFPGKGLEWIGSIHYTGRTMYNPSLMGRPALSMDTSNNQFSLKLRSVTAADTALYFCARDLQWIFVVDPWGQGTLVTVSSASTKG

SEQ ID NO: 7889 - protein, 144 aa, Artificial Sequence
  Description of Artificial Sequence: Synthetic polypeptide
LQQLQVPRLSMWRVFKVAAATGAQTLTVEEPGSSVKVSCKASGGSSTAYGYSWVRQAPGQGFEWMGRIIPFYGIITYAPKFQGRVTITADRSTSTVYMELTSLTFADTALFFCARDFGDPRNGYYFDSWDQGLWLTVSSASTKG

SEQ ID NO: 7890 - protein, 132 aa, Artificial Sequence
  Description of Artificial Sequence: Synthetic polypeptide
QVHLVQSGAEVKKPGSSVRVSCKASGWTFGDSVNSAITWVRQAPGQGLEWMGRFIPILGLSNYAQKFQDRVTINVDRSTNTAYMELSGLRSEDTAVYYCARLITGMNAPWFYYMDVWGKGTTITVSSASTKG

SEQ ID NO: 7891 - protein, 138 aa, Artificial Sequence
  Description of Artificial Sequence: Synthetic polypeptide
FICFSVVVRLLEFGGRLVQPGGSLRLSCSASGFTFSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 7892 - protein, 127 aa, Artificial Sequence
  Description of Artificial Sequence: Synthetic polypeptide
QVQLGQSGTEVKKPGFSVKVSCKASGGSSTAYGYSWVRQAPGQGFEWMGRIIPFYGIITYAPKFQGRVTITADRSTSTVYMELTSLTFADTALFFCARDFGDPRNGYYFDSWDQGLWLTVSSASTKG

SEQ ID NO: 7893 - protein, 127 aa, Artificial Sequence
  Description of Artificial Sequence: Synthetic polypeptide
QVQLVQSGGEVRKPGSSVKVPCKISGNAFSNYGVNWVRQAPGQGLEWVGRIIPVIGVAQHAPKFQGRVTITADKSTTTAYLELSSLRSDDTAVYFCAKDHGDPRTGYYFDYWGQGALVTVSSASTKG

SEQ ID NO: 7894 - protein, 132 aa, Artificial Sequence
  Description of Artificial Sequence: Synthetic polypeptide
QVQLLQSGTEVKKPGSSVKVSCRASGWTLGNSPNSAIGWVRQAPGQGLEWIGRIIPILDVTNYAQKFQGRVTISADKSTNIAYMEISSLGSEDTAFYYCARVITGMTSPWYFYMDVWGEGTTVIVSSASTKG

SEQ ID NO: 7895 - protein, 127 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPCQFQGRVSLTRHASWDFDTFSFYMDLKALRSDDTAVYFCARQRSDYWDFDVWGSGTQVTVSSASTK

SEQ ID NO: 7896 - protein, 134 aa, Artificial Sequence
  Description of Artificial Sequence: Synthetic polypeptide
VQSQVYLVQSGGEVKKPGSSVKVSCKASGDSFSSSVITWVRQAPGQGPEWMGRIIPVLGVAAYAQNFYGRVTISADTSSNTAYMELSSLRFEDTAVFYCARETGRGGNLALRQYFFDSWGQGTLVTVSSPSTKG

SEQ ID NO: 7897 - protein, 123 aa, Artificial Sequence
  Description of Artificial Sequence: Synthetic polypeptide
EVQLVESGGGLVQPGGSLRISCSATGFTFSTHAMHWVRQAPGKGLEYVSAINSNGRSAFYADSVKGRVTISRDNSKNTLFLQMTSLRAEDTAVYYCVKGPLLRYLDSWGQGTLVTVSSASTKG

SEQ ID NO: 7898 - protein, 128 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPCQFQGRVSLTRQASWDFDTISFYMDLKALRLDDTAVYFCARQRSDYWDFDVWGSGTQVTVSSASTKG

SEQ ID NO: 7899 - protein, 128 aa, Artificial Sequence
  Description of Artificial Sequence: Synthetic polypeptide
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGSQVTVSSASTKG

SEQ ID NO: 7900 - protein, 130 aa, Artificial Sequence
  Description of Artificial Sequence: Synthetic polypeptide
QVQLVESGGGLVKPGGSLRLSCAASGFSFNEYYMSWIRQAPGQGLEWVANIGSSDAYTIYADSVKGRFTISRDNAENTVYLQMNSLRGEDTAVYYCARIEGYCSNSRCSNYFDPWGQGALVTVSSASTKG

SEQ ID NO: 7901 - protein, 128 aa, Artificial Sequence
  Description of Artificial Sequence: Synthetic polypeptide
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTGVYFCARQRSDYWDFDVWGSGTQVTVSSASTKG

SEQ ID NO: 7902 - protein, 145 aa, Artificial Sequence
  Description of Artificial Sequence: Synthetic polypeptide
MFLFLVAGATGVQSQVYLVPFGPEVKKPGSSVKVSCKASGDSFTSSVITWVRQAPGQGPEWMGRVIPVLGVAAYAQKFYGRVTITADTSSNTAYMEVNSLRFEDTAVYYCARETGRGGNLALRQYFFDSWGQGTLVTVSSPSTKG

SEQ ID NO: 7903 - protein, 128 aa, Artificial Sequence
  Description of Artificial Sequence: Synthetic polypeptide
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTAVYFCARQRSDYWDFDVWGSGTQVTVSSASTKG

SEQ ID NO: 7904 - protein, 133 aa, Artificial Sequence
  Description of Artificial Sequence: Synthetic polypeptide
CQVQLVESGGGVVQPGRSLRLSCVGSGFTFSSSGMHWVRQAPGKGLEWVAVISSDGSDEYYGDSVEGRFTISRDNSKNTLFLQLDSLEAEDSAVYYCAKTPPHYDALTGYPSSVLEFWGLGTLVTVSSASTKG

SEQ ID NO: 7905 - protein, 123 aa, Artificial Sequence; identical to SEQ ID NO: 7897
  Description of Artificial Sequence: Synthetic polypeptide

SEQ ID NO: 7906 - protein, 132 aa, Artificial Sequence; identical to SEQ ID NO: 7890
  Description of Artificial Sequence: Synthetic polypeptide

SEQ ID NO: 7907 - protein, 126 aa, Artificial Sequence
  Description of Artificial Sequence: Synthetic polypeptide
SGGRLVQPGGSLRLSCSASGFTLSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 7908 - protein, 132 aa, Artificial Sequence
  Description of Artificial Sequence: Synthetic polypeptide
EVQLVQSGAEVKKPGSSVKVSCKASGGTFTTYDISWVRQAPGQGLEWIGGILPDFGAPSYAQKFQDRVTITTDESSRTAYMELNSLRSEDTAIYYCARGRGDDFWSGESPSWYFDYWGQGTQVTVSSASTKG

SEQ ID NO: 7909 - protein, 135 aa, Artificial Sequence
  Description of Artificial Sequence: Synthetic polypeptide
PLVQLEPSGVEVKKRGASVKVSCKVSGYSLTELSMHWVRQAPGKGLEWMGSFDPLDGDTIYAQKFQGRVTMTVDTSTDTAYMDLSSLRFEDTAVYYCATPSKAYYYDSPNYEGDFYMDVWGKGTTVIVSSASTKG

SEQ ID NO: 7910 - protein, 132 aa, Artificial Sequence
  Description of Artificial Sequence: Synthetic polypeptide
QVQLVESGGGVVQPGRSLRLSCVGSGFTFSSSGMHWVRQAPGKGLEWVAVISSDGSDEYYGDSVEGRFTISRDNSKNTLFLQLDSLEAEDSAVYYCAKTPPHYDALTGYPSSVLEFWGLGTLVTVSSASTKG

SEQ ID NO: 7911 - protein, 136 aa, Artificial Sequence
  Description of Artificial Sequence: Synthetic polypeptide
EVQLVQSGAEVKKPGASVKVSCKVSGYTLTELSMHWVRQAPGKGLEWMGVFDPLEGDGVYAEKFRGRVIMTEDTSTDTGYMELTSLRSEDTAIYYCATKAKDYYYESSDYSPYYYYYMDVWGKGTTVTVSSASTKG

SEQ ID NO: 7912 - protein, 132 aa, Artificial Sequence
  Description of Artificial Sequence: Synthetic polypeptide
EVRLLESGGGLVQPGGSLRLSCSASGFTFSNSALSWVRQAPGKGLEWVSSVVSSGGDTFYADSVKGRFTISRDNSRNTLYLQMKSLRAEDTALYYCAKVQIQQLNFGVITDAGMDVWGKGTTVIVSSASTKG

SEQ ID NO: 7913 - protein, 117 aa, Artificial Sequence
  Description of Artificial Sequence: Synthetic polypeptide
VEEPGSSVKVSCKASGGSSTAYGYSWVRQAPGQGFEWMGRIIPFYGIITYAPKFQGRVTITADRSTSTVYMELTRLTFADTALFFCARDYGDPRNGYYFDSWDQGLWLTVSSASTKG

SEQ ID NO: 7914 - protein, 133 aa, Artificial Sequence
  Description of Artificial Sequence: Synthetic polypeptide
GYSEVQLVQSGPGLVKPSQTLSLTCTVSGGSISNGGHYWNWIRQHPGKGLEWIGHIYNIATTYYNPSLKSRVSISVDTSKNQFSLKLSSVTAADTAVYYCARGSGRWTIGARIYFDNWGQGALVAVSSASTKG

SEQ ID NO: 7915 - protein, 123 aa, Artificial Sequence
  Description of Artificial Sequence: Synthetic polypeptide
QVQLVESGGGLVQPGGSLRISCSATGFTFSTHAMHWVRQAPGKGLEYVSAINSNGRSAFYADSVKGRVTISRDNSKNTLFLQMTSLRAEDTAVYYCVKGPLLRYLDSWGQGTLVTVSSASTKG

SEQ ID NO: 7916 - protein, 125 aa, Artificial Sequence
  Description of Artificial Sequence: Synthetic polypeptide
QVQLVQSGPGLVKPSETLSLTCSVSNGSISSGGYYWSWLRQFPGKGLEWIGSIHYTGRTFYNPSLMGRTALSMDTSNNQFSLKVSSVTAADTALYYCARELQWMFVVDPWGQGTLVTVSSASTKG

SEQ ID NO: 7917 - protein, 132 aa, Artificial Sequence; identical to SEQ ID NO: 7894
  Description of Artificial Sequence: Synthetic polypeptide

SEQ ID NO: 7918 - protein, 136 aa, Artificial Sequence
  Description of Artificial Sequence: Synthetic polypeptide
QVQLVQSGGEVKKPGASVKVSCKVSGYSLTELSMHWVRQAPGKGLEWMGVFDPLEGDGVYVQKFRGRVIMTEDTSTDTAYMELTSLRSEDTAIYYCATKAKDYYYESSDYSPYYYYYMDVWGKGTTVTVSSASTKG

SEQ ID NO: 7919 - protein, 136 aa, Artificial Sequence
  Description of Artificial Sequence: Synthetic polypeptide
GSEVQLVESGAEVKKRGASVKVSCKVSGYSLTELSMHWVRQAPGKGLEWMGSFDPLDGDTIYAQKFQGRVTMTVDTSTDTAYMDLSSLRFEDTAVYYCATPSKAYYYDSPNYEGDFYMDVWGKGTTVIVSSASTKG

SEQ ID NO: 7920 - protein, 126 aa, Artificial Sequence
  Description of Artificial Sequence: Synthetic polypeptide
SVVQLVESGPGLVKPSETLSLTCSVSNGSISSGGYYWSWLRQFPGKGLEWIGSIHYTGRTMYNPSLMGRPALSMDTSNNQFSLKLRSVTAADTALYFCARDLQWIFVVDPWGQGTLVTVSSASTKG

SEQ ID NO: 7921 - protein, 134 aa, Artificial Sequence
  Description of Artificial Sequence: Synthetic polypeptide
SVDERLLEFGGRLVQPGGSLRLSCSASGFTFSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

SEQ ID NO: 7922 - protein, 133 aa, Artificial Sequence
  Description of Artificial Sequence: Synthetic polypeptide
QLQLKESGPGMVKPSETLSLTCSVSGASVVSANDYWGWIRQAPGKGLECIGIILYTGSTFYNPSLQSRVTISRDPSKNHVSLTLTSVTAADSAVYYCARIPYHSESYYNVVIGGFDVWGQGTRVTVSSASTKG

SEQ ID NO: 7923 - protein, 132 aa, Artificial Sequence; identical to SEQ ID NO: 7890
  Description of Artificial Sequence: Synthetic polypeptide

SEQ ID NO: 7924 - protein, 127 aa, Artificial Sequence; identical to SEQ ID NO: 7892
  Description of Artificial Sequence: Synthetic polypeptide

SEQ ID NO: 7925 - protein, 126 aa, Artificial Sequence
  Description of Artificial Sequence: Synthetic polypeptide
SQVQLVESGPGLVKPSETLSLTCSVSNGSISSGGYYWSWLRQFPGKGLEWIGSIHYTGRTMYNPSLMGRPALSMDTSNNQFSLKLSSVTAADTALYFCARDLQWIFVVDPWGQGTLVTVSSASTKG

SEQ ID NO: 7926 - protein, 134 aa, Artificial Sequence
  Description of Artificial Sequence: Synthetic polypeptide
RVHSQVQLVESGPGLVKPSQTLSLTCTVSGGSISNGGHYWNWIRQHPGKGLEWIGHIYNIATTYYNPSLKSRVSISVDTSKNQFSLKLSSVTAADTAVYYCARGSGRWTIGARIYFDNWGQGALVAVSSASTKG

SEQ ID NO: 7927 - protein, 127 aa, Artificial Sequence; identical to SEQ ID NO: 7893
  Description of Artificial Sequence: Synthetic polypeptide

SEQ ID NO: 7928 - protein, 131 aa, Artificial Sequence
  Description of Artificial Sequence: Synthetic polypeptide
QVHLVQSGAEVKKPGSSVRVSCEASGWTFGSVNSAITWVRQAPGQGLEWMGRTIPFLGISNYAQKFQGRVTITADKSTNIAYVDVTSLTSQDTAVYYCARLITGMTAPWFYYMDVWGKGTTVTVSSASTKG

SEQ ID NO: 7929 - protein, 128 aa, Artificial Sequence
  Description of Artificial Sequence: Synthetic polypeptide
QVHLSQSGAVVTKPGASVRVSCEASGYKISDHFIHWWRQAPGQGPQWVGWINPKTGQPNNPRQFQGRISLTRQASWDFDTFSFYMDLKALRSDDTAVYFCARHRSDYWDFDVWGSGTQVTVSSASTKG

SEQ ID NO: 7930 - protein, 128 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYRDFDVWGSGTQVTVSSASTKG

SEQ ID NO: 7931 - protein, 128 aa, Artificial Sequence
  Description of Artificial Sequence: Synthetic polypeptide
QVHLSQSGAAVTKPGASVRVSCEASGYKIRDYSIHWWRQAPGQGLQWVGWINPQTGQPNIPRPFQGRISLTRQASWDFDTFSFYMDLEALRSDDTAVYFCARQRSDYWDFDVWGSGTQVTVSSASTKG

SEQ ID NO: 7932 - protein, 128 aa, Artificial Sequence
  Description of Artificial Sequence: Synthetic polypeptide
QVHLSQSGAVVTKPGASVRVSCEASGYKISDHFIHWWRQAPGQGLQWVGWINPKTGQPNNPRQFQGRISLTRQASWDFDTFSFYMDLEALRSDDTAVYFCARQRSDYWDFDVWGSGTQVTVSSASTKG

SEQ ID NO: 7933 - protein, 128 aa, Artificial Sequence
  Description of Artificial Sequence: Synthetic polypeptide
QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 7934 - protein, 128 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRVSLTRQASWDFDTYSFYMGLKAVRSDDTAIYFCARQRSDFWDFDVWGSGTQVTVSSASTKG

SEQ ID NO: 7935 - protein, 128 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 7936 - protein, 128 aa, Artificial Sequence
  Description of Artificial Sequence: Synthetic polypeptide
QVHLSQSGAVVTKPGASVRVSCEASGYKISGHFIHWWRQAPGQGLQWVGWINPKTGQPNNPRQFQGRISLTRQASWDFDTFSFYMDLKALRSDDTAVYFCARHRSDYWDFDVWGSGTQVTVSSASTKG

SEQ ID NO: 7937 - protein, 128 aa, Artificial Sequence
  Description of Artificial Sequence: Synthetic polypeptide
QVHLSQSGAVVTKPGASVRVSCEASGYKISDHFIHWWRQAPGQGLQWVGWINPKTGQPNIPRQFQGRISLTRQASGDFDTFSFYMDLKALRSDDTAVYFCARQRSDYWDFGVWGSGTQVTVSSASTKG

SEQ ID NO: 7938 - protein, 128 aa, Artificial Sequence
  Description of Artificial Sequence: Synthetic polypeptide
QVHLSQSGAVVTKPGASVRVSCEASGYKISDHFIHWWRQAPGQGLQWVGWINPKTGQPNNPRQFQGRISLTRQASWDIDTFSFYMDLKALRSDDTAVYFCARHRSDYWDFDVWGSGTQVTVSSASTKG

SEQ ID NO: 7939 - protein, 128 aa, Artificial Sequence
  Description of Artificial Sequence: Synthetic polypeptide
QVHLSQSGAVVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 7940 - protein, 128 aa, Artificial Sequence
  Description of Artificial Sequence: Synthetic polypeptide
QVHLSHSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 7941 - protein, 128 aa, Artificial Sequence; identical to SEQ ID NO: 7933
  Description of Artificial Sequence: Synthetic polypeptide

SEQ ID NO: 7942 - protein, 128 aa, Artificial Sequence; identical to SEQ ID NO: 7933
  Description of Artificial Sequence: Synthetic polypeptide

SEQ ID NO: 7943 - protein, 128 aa, Artificial Sequence; identical to SEQ ID NO: 7935
  Description of Artificial Sequence: Synthetic polypeptide

SEQ ID NO: 7944 - protein, 130 aa, Artificial Sequence
  Description of Artificial Sequence: Synthetic polypeptide
EVQLVQSGSDVKKPGTTVTISCKADEDEDDFTAYNYFMHWVRQAPGQGLEWIGWINPRTGQPNHAKQLQGRVTLTRERSTSTVFMKLTNLRLDDTAVYFCARPLRGGDTWHYHSWGRGTSLIVSSASTKG

SEQ ID NO: 7945 - protein, 130 aa, Artificial Sequence; identical to SEQ ID NO: 7944
  Description of Artificial Sequence: Synthetic polypeptide

SEQ ID NO: 7946 - protein, 132 aa, Artificial Sequence
  Description of Artificial Sequence: Synthetic polypeptide
QPQLVQSGSGAEVKKPGASVRISCEASEYNVFDHFMQWVRQAPGQGLEWMGWINPRGGYPSYSPRFQGRLTFTRQPSWDDSSVTFHMELRGLRHDDTAVYYCARPHSPDDAWSLDVWGRGTLVTVSSASTKG

SEQ ID NO: 7947 - protein, 130 aa, Artificial Sequence
  Description of Artificial Sequence: Synthetic polypeptide
EVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 7948 - protein, 128 aa, Artificial Sequence
  Description of Artificial Sequence: Synthetic polypeptide
HVQLLQSGAAVTKPGASVRVSCEASGYNIRDYFIHWWRQAPGQGLQWVGWINPKTGQPNNPRQFQGRVSLTRQASWDFDTFSFYMDLKALRLDDTAIYFCARQRSDYWDFDVWGSGTQVTVSSASTKG

SEQ ID NO: 7949 - protein, 130 aa, Artificial Sequence
  Description of Artificial Sequence: Synthetic polypeptide
VVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 7950 - protein, 124 aa, Artificial Sequence
  Description of Artificial Sequence: Synthetic polypeptide
QVQLVQSGAALKKPGASLRISCQAYGYKFTDYLIHWWRQAPGQGLEWIGWIKPETGQPSYSYKFQGRVSLTRDTFEEILFMDLRGLRSDDTAIYFCARRHSDYCDFDVWGGGSQVLVSSASTKG

SEQ ID NO: 7951 - protein, 124 aa, Artificial Sequence
  Description of Artificial Sequence: Synthetic polypeptide
QVQLVQSGTAVKKPGASVRVSCQASGYTFTDYFIYWWRQAPGQGLEWLGWINPRTSQPSYPYRFQGRVTLTRDIFEEMLYMDLRGLRSDDTGIYFCARRHSDYCDFDIWGSGTQIIVSSASTKG

SEQ ID NO: 7952 - protein, 130 aa, Artificial Sequence; identical to SEQ ID NO: 7947
  Description of Artificial Sequence: Synthetic polypeptide

SEQ ID NO: 7953 - protein, 130 aa, Artificial Sequence; identical to SEQ ID NO: 7947
  Description of Artificial Sequence: Synthetic polypeptide

SEQ ID NO: 7954 - protein, 226 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTYSFYMDLKALRSDDTAVYFCARQRSDYWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 7955 - protein, 128 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKG

SEQ ID NO: 7956 - protein, 136 aa, Artificial Sequence
  Description of Artificial Sequence: Synthetic polypeptide
QSQVHLVQSGAEVKKPGSSVKVSCQASGGTFNTFAINWVRQAPGQGLEWVGGIIPVFGTASYAQKFQGRVTVTTDESRGTAYMELNSLRSEDTAVYYCARGQTDLNDDLWSDYSTPGFDYWGQGTLVTVSSASTKG

SEQ ID NO: 7957 - protein, 132 aa, Artificial Sequence
  Description of Artificial Sequence: Synthetic polypeptide
QPQLVQSGSGAEVKKPGASVRISCEASEYNVFDHFMQWVRQAPGQGLEWMGWINPRGGYPSYSPTFQGRLTFTRQPSWDDSTITFHMELRGLGHDDTAVYYCARPHSPDDAWSLDVWGRGTLVTVSSASTKG

SEQ ID NO: 7958 - protein, 130 aa, Artificial Sequence
  Description of Artificial Sequence: Synthetic polypeptide
EVQLVESGSDVRKPGATVTVSCKADEDEDDFTAYNYFMHWVRQAPGQGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 7959 - protein, 128 aa, Artificial Sequence
  Description of Artificial Sequence: Synthetic polypeptide
RVQLGQSGAEVKKPGASVKVSCKVSGNSLTEFSIHWVRQAPGKGLEWMGGFDPEEGETVPAQKFKGRVTMTEDTSTNTAYMELSSLRSEDTAVYYCSTEPREMGTLTAGFEYWGQGTLVIVSSASTKG

SEQ ID NO: 7960 - protein, 124 aa, Artificial Sequence
  Description of Artificial Sequence: Synthetic polypeptide
QVQLVQSGAALKKPGASLRISCQAYGYKFTDHLIYWWRQAPGQGLEWIGWIKPETGQPSYSYKFQGRVSLTRDTFQEILFMNLRGLRSDDTAIYFCARRHSDYCDFDVWGSGSQILVSSASTKG

SEQ ID NO: 7961 - protein, 130 aa, Artificial Sequence; identical to SEQ ID NO: 7947
  Description of Artificial Sequence: Synthetic polypeptide

SEQ ID NO: 7962 - protein, 130 aa, Artificial Sequence; identical to SEQ ID NO: 7949
  Description of Artificial Sequence: Synthetic polypeptide

SEQ ID NO: 7963 - protein, 124 aa, Artificial Sequence
  Description of Artificial Sequence: Synthetic polypeptide
QVQLVQSGAALKKPGASVRISCQAYGYKFTDHLIYWWRQAPGQGLEWIGWIKPETGQPSYSYKFQGRVTLTRDTFEEIHFMDLRGLRYDDTATYFCARRHSDYCDFDVWGSGSQVSVSSASTKG

SEQ ID NO: 7964 - protein, 130 aa, Artificial Sequence
  Description of Artificial Sequence: Synthetic polypeptide
QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSRGRGTSLTVSSASTKG

SEQ ID NO: 7965 - protein, 132 aa, Artificial Sequence
  Description of Artificial Sequence: Synthetic polypeptide
QPQLVQSGSGAEVKKPGASVRISCEASEYNVFDHFMQWVRQAPMEGLEWMGWINPRGGYPSYSPTFQGRLTFTRQPSWDDSTITFHMELRGLRHDDTAVYYCARPHSPDDAWSLDVWGRGTLVTVSSASTKG

SEQ ID NO: 7966 - protein, 132 aa, Artificial Sequence; identical to SEQ ID NO: 7965
  Description of Artificial Sequence: Synthetic polypeptide

SEQ ID NO: 7967 - protein, 124 aa, Artificial Sequence
  Description of Artificial Sequence: Synthetic polypeptide
QVQLVQSGATLKKPGASVRISCQAYGYKFTDHLIHWWRQAPGQGLEWIGWIKPETGQPSYAYKFQGRVSLTRDTFEEILFMDLRGLRSDDTAIYFCARRHSDYCDLDVWGGGTQLLVSSASTKG

SEQ ID NO: 7968 - protein, 124 aa, Artificial Sequence
  Description of Artificial Sequence: Synthetic polypeptide
QVQLVQSGAALKKPGASLRISCLTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVIVSSASTKG

SEQ ID NO: 7969 - protein, 124 aa, Artificial Sequence
  Description of Artificial Sequence: Synthetic polypeptide
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGGGSQVIVSSASTKG

SEQ ID NO: 7970 - protein, 124 aa, Artificial Sequence
  Description of Artificial Sequence: Synthetic polypeptide
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVIVSSASTKG

SEQ ID NO: 7971 - protein, 124 aa, Artificial Sequence
  Description of Artificial Sequence: Synthetic polypeptide
QVQLVQSGAALKKPGASVRISCQTYGYKFTDHLIHWWRQAPGQGLEWIGWIKPDTGQPSYSSRFQGRVSLTRDTFEEIVFMDLRGLRSDDTAIYFCARRHSDYCDFDVWGSGSQVLVSSASTKG

SEQ ID NO: 7972 - protein, 124 aa, Artificial Sequence
  Description of Artificial Sequence: Synthetic polypeptide
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVLVSSASTKG

SEQ ID NO: 7973 - protein, 130 aa, Artificial Sequence
  Description of Artificial Sequence: Synthetic polypeptide
QVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 7974 - protein, 130 aa, Artificial Sequence; identical to SEQ ID NO: 7947
  Description of Artificial Sequence: Synthetic polypeptide

SEQ ID NO: 7975 - protein, 128 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKGLRSDDTAIYFCARQRSDYWDFDVWGSGTQVTVSSASTKG

SEQ ID NO: 7976 - protein, 136 aa, Artificial Sequence
  Description of Artificial Sequence: Synthetic polypeptide
LQPRVHSEVQLVESGAEVKKPGASVKVSCKVSGYTLSDLSMHWVRQAPGKGLEWMGGFDEEDGEITYAQKFQGRVSMTEDTSRDTAYMELSSLRSEDTAVYYCATAPRLELGELSSGFHYWGLGTLVTVSSASTKG

SEQ ID NO: 7977 - protein, 128 aa, Artificial Sequence; identical to SEQ ID NO: 7959
  Description of Artificial Sequence: Synthetic polypeptide

SEQ ID NO: 7978 - protein, 130 aa, Artificial Sequence
  Description of Artificial Sequence: Synthetic polypeptide
EVQLVQSGSDVRKPGATVTVSCKADEDEDDFTAYDYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 7979 - protein, 130 aa, Artificial Sequence; identical to SEQ ID NO: 7947
  Description of Artificial Sequence: Synthetic polypeptide

SEQ ID NO: 7980 - protein, 130 aa, Artificial Sequence; identical to SEQ ID NO: 7947
  Description of Artificial Sequence: Synthetic polypeptide

SEQ ID NO: 7981 - protein, 124 aa, Artificial Sequence; identical to SEQ ID NO: 7951
  Description of Artificial Sequence: Synthetic polypeptide

SEQ ID NO: 7982 - protein, 128 aa, Artificial Sequence
  Description of Artificial Sequence: Synthetic polypeptide
QVQLLQSGAAVTKPGASVRVSCEASGYKISDHFIHWWRQAPGQGLQWVGWINPKTGQPNNPRQFQGRISLTRQASWDFDTFSFYMDLKALRSDDTAVYFCARQRSDYWDFDVWGSGTQVTVSSASTKG

SEQ ID NO: 7983 - protein, 130 aa, Artificial Sequence; identical to SEQ ID NO: 7973
  Description of Artificial Sequence: Synthetic polypeptide

SEQ ID NO: 7984 - protein, 129 aa, Artificial Sequence
  Description of Artificial Sequence: Synthetic polypeptide
WQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 7985 - protein, 124 aa, Artificial Sequence
  Description of Artificial Sequence: Synthetic polypeptide
QVQLVQSGAALKKPGASVRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVLVSSASTKG

SEQ ID NO: 7986 - protein, 129 aa, Artificial Sequence; identical to SEQ ID NO: 7984
  Description of Artificial Sequence: Synthetic polypeptide

SEQ ID NO: 7987 - protein, 125 aa, Artificial Sequence
  Description of Artificial Sequence: Synthetic polypeptide
QVQLVQSGAALKKPGASVRISCQAYGYKFTDYLIHWWRQAPGQGLEWIGWIKPETGQPSYSYKFQGRVTLTRDTFEEILFMDLRGLRSDDTAIYFCARRHSDYCDFDVWGSGSQVIVSSASTKGA

SEQ ID NO: 7988 - protein, 130 aa, Artificial Sequence
  Description of Artificial Sequence: Synthetic polypeptide
EVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 7989 - protein, 130 aa, Artificial Sequence; identical to SEQ ID NO: 7949
  Description of Artificial Sequence: Synthetic polypeptide

SEQ ID NO: 7990 - protein, 136 aa, Artificial Sequence
  Description of Artificial Sequence: Synthetic polypeptide
IWAPLIAVTFLVLHCESLGTCCCCQASGGTFNTFAINWVRQAPGQGLEWVGGIIPVFGTASYAQKFQGRVTVTTDESRGTAYMELNSLRSEDTAVYYCARGQTDLNDDLWSDYSTPGFDYWGQGTLVTVSSASTKG

SEQ ID NO: 7991 - protein, 124 aa, Artificial Sequence
  Description of Artificial Sequence: Synthetic polypeptide
QVQLVQSGAALKKPGASVRISCQAYGYKFTDHLIYWWRQAPGQGLEWIGWIKPETGQPSYAYKFQGRVTLTRDTFEEIHFMDLRGVRNDDTATYFCARRHSDYCDFDVWGSGSQVIVSSASTKG

SEQ ID NO: 7992 - protein, 130 aa, Artificial Sequence; identical to SEQ ID NO: 7988
  Description of Artificial Sequence: Synthetic polypeptide

SEQ ID NO: 7993 - protein, 124 aa, Artificial Sequence
  Description of Artificial Sequence: Synthetic polypeptide
QVQLVQSGTAVKRPGASVRVSCQASGYTFTDYFIYWWRQAPGQGLEWLGWINPLTSQPSYPSRFQGRLTLTRDTFDEMLYMDLRGLRSDDTGIYFCARRHSDYCDFDIWGSGTQIIVSSASTKG

SEQ ID NO: 7994 - protein, 129 aa, Artificial Sequence
  Description of Artificial Sequence: Synthetic polypeptide
EVQLVESGAEVKKPGASVKVSCKVSGYTLSDLSMHWVRQAPGKGLEWMGGFDEEDGEITYAQKFQGRVSMTEDTSRDTAYMELSSLRSEDTAVYYCATAPRLELGELSSGFHYWGLGTLVTVSSASTKG

SEQ ID NO: 7995 - protein, 130 aa, Artificial Sequence; identical to SEQ ID NO: 7947
  Description of Artificial Sequence: Synthetic polypeptide

SEQ ID NO: 7996 - protein, 128 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSSASTKG

SEQ ID NO: 7997 - protein, 128 aa, Artificial Sequence; identical to SEQ ID NO: 7901
  Description of Artificial Sequence: Synthetic polypeptide

SEQ ID NO: 7998 - protein, 128 aa, Artificial Sequence
  Description of Artificial Sequence: Synthetic polypeptide
QVHLSQSGAAVTKPGASVRVSCEASGYKISDHFIHWWRQAPGQGLQWVGWINPKTGQPNNPRQFQGRVSLTRQASWDFDTYSFYMDLKALRSDDTAIYFCARQRSDFWDFDVWGSGTQVTVSSASTKG

SEQ ID NO: 7999 - protein, 128 aa, Artificial Sequence
  Description of Artificial Sequence: Synthetic polypeptide
QVQLLPFGGAVTKPGASVRVSCEASGYNIRDYFIHWWRQAPGQGLQWVGWINPKTGQPNNPCQFQGRVSLTRPASWDFDTISFYMDLKALRLDDTAVYFCARQRSDYWDFDVWGSGTQVTVSSASTKG

SEQ ID NO: 8000 - protein, 124 aa, Artificial Sequence
  Description of Artificial Sequence: Synthetic polypeptide
QVQLVQSGAALKKPGASLRISCQTYGYKFTDHLIYWWRQAPGQGLEWIGWIKPETGQPSYSYRFQGRVSLTRDTFEEIAFMDLRGLRSDDTAIYFCARRHTDYCVFDVWGSGSQIIVSSASTKG

SEQ ID NO: 8001 - protein, 130 aa, Artificial Sequence
  Description of Artificial Sequence: Synthetic polypeptide
QVQLVESGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSSASTKG

SEQ ID NO: 8002 - protein, 124 aa, Artificial Sequence
  Description of Artificial Sequence: Synthetic polypeptide
QVQLVQSGAALKKPGASLRISCQTYGYKFTDHLIYWWRQAPGQGLEWMGWIKPETGQPSYSYRFQGRVSLTRDTFEEIVFMDLRGLRSDDTAIYFCARRHSDYCDFDVWGSGSQVIVSSASTKG

SEQ ID NO: 8003 - protein, 128 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVYSASTKG

SEQ ID NO: 8004 - protein, 129 aa, Artificial Sequence
  Description of Artificial Sequence: Synthetic polypeptide
EVQLVESGAEVKKPGASVKVACKVSGKKLSDLSIHWVRQAPGKGLEWMGGFDEEDGKISYERKFQGRVTMTEDTARDTAFMEMSSLRSDDTAVYFCAAAPRLDLGELSSGFHFWGLGTLVSVSSASTKG

SEQ ID NO: 8005 - protein, 128 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRQFQGRVSLTRQASWDFDTISFYMDLKALRLDDTAVYFCARQRSDYWDFDVWGSGTQVTVSSASTKG

SEQ ID NO: 8006 - protein, 125 aa, Artificial Sequence
  Description of Artificial Sequence: Synthetic polypeptide
RQVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQILVSSASTKG

SEQ ID NO: 8007 - protein, 136 aa, Artificial Sequence
  Description of Artificial Sequence: Synthetic polypeptide
CNPRVHSEVQLVESGAEVKKPGASVKVACKVSGKKLSDLSIHWVRQAPGKGLEWMGGFDEEDGKISYERKFQGRVSMTEDTARDTAFMEMSSLRSDDTAVYFCAAAPRLDLGELSSGFHFWGLGTLVTVSSASTKG

SEQ ID NO: 8008 - protein, 124 aa, Artificial Sequence
  Description of Artificial Sequence: Synthetic polypeptide
QVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQVIVSSASTKG

SEQ ID NO: 8009 - protein, 130 aa, Artificial Sequence; identical to SEQ ID NO: 7973
  Description of Artificial Sequence: Synthetic polypeptide

SEQ ID NO: 8010 - protein, 128 aa, Artificial Sequence; identical to SEQ ID NO: 7955
  Description of Artificial Sequence: Synthetic polypeptide

SEQ ID NO: 8011 - protein, 124 aa, Artificial Sequence
  Description of Artificial Sequence: Synthetic polypeptide
QVQLVQSGTAVKRPGASVRVSCQASGYTFIDHFIYWWRQAPGQGLEWLGWINPLTSQPSYPSRFQGRLTLTRDTFDEMLYMDLRGLRSDDTGIYFCARRHSDYCDFDIWGSGTQIIVSSASTKG

SEQ ID NO: 8012 - protein, 128 aa, Artificial Sequence
  Description of Artificial Sequence: Synthetic polypeptide
EVQLVESGAEVKKPGASVKVSCKVSGNSLTEFSIHWVRQAPGKGLEWMGGFDPEEGETVPAQKFKGRLTMTEDTSTNTAYMELSSLRSEDTAVYYCSTEPREMGTLTAGFEYWGQGTLVTVSSASTKG

SEQ ID NO: 8013 - protein, 128 aa, Artificial Sequence
  Description of Artificial Sequence: Synthetic polypeptide
QVQLLQSGAVVTKPGASVRVSCEASGYKIRDYFIHWWRQAPGQGLQWVGWINPQTGQPNIPRPFQGRVTLTRHASWDFDTFSFYMDLKALRSDDTAIYFCARRRSDYCDFDVWGSGTHVTVSSASTKG

SEQ ID NO: 8014 - protein, 130 aa, Artificial Sequence; identical to SEQ ID NO: 7947
  Description of Artificial Sequence: Synthetic polypeptide

SEQ ID NO: 8015 - protein, 130 aa, Artificial Sequence; identical to SEQ ID NO: 7973
  Description of Artificial Sequence: Synthetic polypeptide

SEQ ID NO: 8016 - protein, 128 aa, Artificial Sequence
  Description of Artificial Sequence: Synthetic polypeptide
QVQLLQSGAAVTKPGASVRVSCEASGYNIRDYFIHWWRQAPGQGLQWVGWINPKTGQPNNPRLFQGRVSLTRHASWDFDTFSFYMDLKAVRSDDTAVYFCARQRSDYWDFDVWGSGTQVTVSSASTKG

SEQ ID NO: 8017 - protein, 231 aa, Artificial Sequence
  Description of Artificial Sequence: Synthetic polypeptide
  MOD_RES (104)..(104): Any amino acid
  MOD_RES (107)..(107): Any amino acid
EVQLVQSGAEVKKPGSSVKVSCKASGGTFSNYAINWVRQAPGQGLEWMGGIIPIFNIAHYAQRFQGRVSITADESTSTAYMELSSLRSEDTAVFYCASPYPNDXNDXAPEEGMSWYFDLWGRGTLVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 8018 - protein, 125 aa, Artificial Sequence
  Description of Artificial Sequence: Synthetic polypeptide
QSGAEVKKPGASVKVSCKASGYTYTTYGVSWLRQVPGQRPEWMGWIRPKTGARNQARQFQPRISLTRDRALSTAYLDLNSLTSADSGTYFCARQTFKPDFYFADQGWSFNLWGRGAHFIVSSAST

SEQ ID NO: 8019 - protein, 119 aa, Artificial Sequence
  Description of Artificial Sequence: Synthetic polypeptide
QSGAEVKRPGASVRVSCRASGYTFNNFYMYWVRQAPGQGLEYVGWINPNTGTTKYAQKFQGWVTLTLDTSITTAYLEMGRLTPDDTALFYCATVAGPAADEAFDVWGQGTMVTVSSAST

SEQ ID NO: 8020 - protein, 130 aa, Artificial Sequence
  Description of Artificial Sequence: Synthetic polypeptide
QSGSAMKKPGASVRVSCWTSEDIFDTTELIYWMRQAPGQGLEWIGWVKIVSGTVNFASLDFRNRISLSRDRDLSTAHMDIRGLTQDDTAVYYCTSDRRGSGNSYVPDHYHYYGMDVWGQGTTVTVSSAST

SEQ ID NO: 8021 - protein, 121 aa, Artificial Sequence
  Description of Artificial Sequence: Synthetic polypeptide
QSGAEVKKPGASVKVSCKASGYTFTSYDINWVRQATGQGLEWIGWVKTVTGAVNFGSSDFRQRVSLTRDRDLFTAHMDIRGLTQGDTATYFCARQKFYAGGQGWYFDLWGRGTLIVVSSAS

SEQ ID NO: 8022 - protein, 238 aa, Artificial Sequence
  Description of Artificial Sequence: Synthetic polypeptide
QVQLVQPGTAMKSLGSSLTITCRVSGDDLGSFHFGTYFMIWVRQAPGQGLEYMGGILPSTKTPTYAHKFRGRVSISAPGVPPVLSLALTNLTYDDTATYFCARERGRHFEPKNRDNLEGKFFDLWGRGTFVRVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8023 - protein, 229 aa, Artificial Sequence
  Description of Artificial Sequence: Synthetic polypeptide
  MOD_RES (1)..(1): Any amino acid
XVRLSQSGGQMKKPGESMRLSCRASGYEFLNCPINWIRLAPGRRPEWMGWLKPRWGAVNYARKFQGRVTMTRDVYSDTAFLELRSLTSDDTAVYFCTRGKYCTARDYYNWDFEHWGRGAPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCD

SEQ ID NO: 8024 - protein, 125 aa, Artificial Sequence
  Description of Artificial Sequence: Synthetic polypeptide
QSGSGVKKPGASVRVSCWTSEDIFERTELIHWVRQAPGQGLEWIGWVKTVTGTVNYARKFQGRVSFYRTRELGIAYMDLRNLRFDDTAVYFCARKTAGDVSGDKRGFFFDLWGRGSRVIVSSAST

SEQ ID NO: 8025 - protein, 117 aa, Artificial Sequence
  Description of Artificial Sequence: Synthetic polypeptide
QSGSAMKKPGASVRVSCWTSEDIFDTTELIYWVRQAPGQGLEWIGWVKIVSGTVNFASLDFRNRISLSRDRDLSTAHMDIRGLTDDTGIYYCARGPMGGSHVYWGQGSLVTVSSAST

SEQ ID NO: 8026 - protein, 129 aa, Artificial Sequence
  Description of Artificial Sequence: Synthetic polypeptide
GSQVQLVQSGAEVKRPGSSVTVSCKASGGSFSTYALSWVRQAPGRGLEWMGGVIPLLTITNYAPRFQGRITITADRSTSTAYLELNSLRPEDTAVYYCAREGTTGWGWLGKPIGAFAHWGQGTLVTVSS

SEQ ID NO: 8027 - protein, 122 aa, Artificial Sequence
  Description of Artificial Sequence: Synthetic polypeptide
QSGSAMKKPGASVRVSCWTSEDIFDTTELIHWVRQAPGQGLEWIGWVKAVSGAVNYGSLDFRHRVSLTRDRDLSTAHMDIRGLTQDDTATYFCARQKFARGDQWFFDLWGRGTLIVVSSAST

SEQ ID NO: 8028 - protein, 125 aa, Artificial Sequence
  Description of Artificial Sequence: Synthetic polypeptide
QSGAELKKPGSSVRVSCKTSGGSFNNYAINWVRQAPGQGLEWIGWVKTVSGTVNFASLDFRNRISLSRDRDPSTAYMDIRGLTQDDTATYFCARQKFASRYSGDQGSYFDLWGRGTLIVVSSAST

SEQ ID NO: 8029 - protein, 123 aa, Artificial Sequence
  Description of Artificial Sequence: Synthetic polypeptide
QSGAEVKKPGASVRVSCWTSEDIFEKSELIHWVRQAPGQGLEWIGWVKTVTGAVNFGSSDFRQRVSLTRDRDLFTAHMDIRGLTQGDTATYFCARQKFERGGQGWYFDLWGRGTLIVVSSAST

SEQ ID NO: 8030 - protein, 122 aa, Artificial Sequence
  Description of Artificial Sequence: Synthetic polypeptide
QSGSGVKKPGASVRVSCWTSEGIFEKSELIHWVRQAPGQGLEWIGWVKTVTGAVNFGHQISDRVSLTRDRDLFTAHMDIRGLTQGDTATYFCARQKFERGGQGWIFDLWGRGTLIAVSSAST

SEQ ID NO: 8031 - protein, 116 aa, Artificial Sequence
  Description of Artificial Sequence: Synthetic polypeptide
QSGAEVKRPGASLNVSCHASGYLFNNYYIHWVRQAPGQGLEWMGWINPTTKITNLPLKFRGRVTLTREPSKSILYGLNGLTPDDTAIYFCARSGEQIAHLDFWGQGSLITVSAAST

SEQ ID NO: 8032 - protein, 123 aa, Artificial Sequence
  Description of Artificial Sequence: Synthetic polypeptide
QSGAEVKRPGASVKVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSSAST

SEQ ID NO: 8033 - protein, 119 aa, Artificial Sequence
  Description of Artificial Sequence: Synthetic polypeptide
QSGAEVRRPGASVKVSCKASGYNFIAYHVHWVRQAPGQGLTWMGWINPDSGDTVYAQNFVDRVMMTRNTSIQTVYLELNVLTLEDTAIYFCATPDKKSDLGWFDTWGQGSQVTVSSAST

SEQ ID NO: 8034 - protein, 125 aa, Artificial Sequence
  Description of Artificial Sequence: Synthetic polypeptide
QSGSGVKKPGASVRVSCWTSEDIFERTELIHWVRQAPGQGLEWLGWMKPVTGAVNYARKFQGRVSFYRTRELGIAYMDLRDLKFDDTAVYFCARKTKGDVSGDGRGFFFDLWGRGTRVIISSAST

SEQ ID NO: 8035 - protein, 126 aa, Artificial Sequence
  Description of Artificial Sequence: Synthetic polypeptide
QSGSGVKKLGASVRVSCWTSEDIFERTELIHWVRQAPGQGLEWMGWINPNSGGTYYAQKFQGRVTMTTDTSTNTAYMELRSLRSDDTAVYYCARDVLRYFDWFLGVEYYFEYWGQGTLVTVSSAST

SEQ ID NO: 8036 - protein, 252 aa, Artificial Sequence
  Description of Artificial Sequence: Synthetic polypeptide
METDTLLLWVLLLWVPGSTGDQVQLVQSGGGVFKPGGSLRLSCEASGFTFTEYYMTWVRQAPGKGLEWLAYISKNGEYSKYSPSSNGRFTISRDNAKNSVFLQLDRLSADDTAVYYCARADGLTYFSELLQYIFDLWGQGARVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 8037 - protein, 131 aa, Artificial Sequence; identical to SEQ ID NO: 7755
  Description of Artificial Sequence: Synthetic polypeptide

SEQ ID NO: 8038 - protein, 131 aa, Artificial Sequence; identical to SEQ ID NO: 7684
  Description of Artificial Sequence: Synthetic polypeptide

SEQ ID NO: 8039 - protein, 125 aa, Artificial Sequence
  Description of Artificial Sequence: Synthetic polypeptide
QFGAEVKKPGSSVKVSCKASGGTFSNNAFSWVRQAPGQGLEWIGWVKTVTGAVNFGSLDFRHRISLTRDRDLFTAHMDIRGLTQGDTATYFCARQKFESRYTGGQGWYFDLWGRGTHIVVSSAST

SEQ ID NO: 8040 - protein, 123 aa, Artificial Sequence
  Description of Artificial Sequence: Synthetic polypeptide
QSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSAST

SEQ ID NO: 8041 - protein, 125 aa, Artificial Sequence
  Description of Artificial Sequence: Synthetic polypeptide
QSGAEVKRPGASVMVSCKASGYTFLNYAFSWVRQAPGQGLEWIGWVKTVSGAVNFGSTDFRERVSLTRDRDLFTAHMDIRGLTQGDTATYTCARQKFEKLYTGDQGLYFDLWGRGTLIIVSSAST

SEQ ID NO: 8042 - protein, 122 aa, Artificial Sequence
  Description of Artificial Sequence: Synthetic polypeptide
QSGAEVKKPGASVQVSCKASGYPFTKYYMHWVRQAPGQGLEWIGWVKAVSGAVNYGSLDFRHRVSLTRDRDLSTAHMDIRGLTQDDTATYFCARQKFARGDQGWFFDLWGRGTLIVVSSAST

SEQ ID NO: 8043 - protein, 125 aa, Artificial Sequence
  Description of Artificial Sequence: Synthetic polypeptide
QSGAEVKKPGASVKVSCRASGYTFGNHAISWVRQAPGQGLEWMGWIRPKTGARNQARQFQPRISLTRDRALSTAYLDLNSLTSADSGTYFCARQTFKPDFYFADQGWSFNLWGRGAHFIVSSAST

SEQ ID NO: 8044 - protein, 129 aa, Artificial Sequence
  Description of Artificial Sequence: Synthetic polypeptide
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYCARDGLGEVAPDYRYGIDVWGQGSTVIVTAASTKG

SEQ ID NO: 8045 - protein, 129 aa, Artificial Sequence
  Description of Artificial Sequence: Synthetic polypeptide
QGLLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 8046 - protein, 129 aa, Artificial Sequence
  Description of Artificial Sequence: Synthetic polypeptide
FQGHLVQSGGGVKKPGTSVTLSCLASEYTFTEFTIHWIRQAPGQGPLWLGLIKRSGRLMTSYRFQDRLSLRRDRSTGTVFMELRSLRTDDTAVYYCARDGLGELAPAYHYGIDAWGQGTTVIVTSASTS

SEQ ID NO: 8047 - protein, 127 aa, Artificial Sequence
  Description of Artificial Sequence: Synthetic polypeptide
QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSAST

SEQ ID NO: 8048 - protein, 128 aa, Artificial Sequence
  Description of Artificial Sequence: Synthetic polypeptide
QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS

SEQ ID NO: 8049 - protein, 127 aa, Artificial Sequence
  Description of Artificial Sequence: Synthetic polypeptide
  MOD_RES (10)..(10): Any amino acid
GHLVQSGGGXKKPGTSVTISCLASEYTFTEFTIHRIRQAPGQGPLWLGLIKGSGRLMTSYGFQDRLSLRRDRSTGTVFMELRSLRTDDTAVYYCARDGLGELAPAYHYGIDVWGQGTTVIVTSASTS

SEQ ID NO: 8050 - protein, 132 aa, Artificial Sequence
  Description of Artificial Sequence: Synthetic polypeptide
GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGTTVIVTSASTS

SEQ ID NO: 8051 - protein, 129 aa, Artificial Sequence
  Description of Artificial Sequence: Synthetic polypeptide
FQGQLVQSGGGVKKPGSSVTISCLASEYTFTEFTIHWIRQAPGQGPLWLGLIKRSGRLMTSYGFQDRLSVRRDRSTGTVFMELRSLRTDDTAVYYCARDGLGELAPAYHYGIDVWGQGTTVIVTSASTS

SEQ ID NO: 8052 - protein, 128 aa, Artificial Sequence
  Description of Artificial Sequence: Synthetic polypeptide
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTS

SEQ ID NO: 8053 - protein, 130 aa, Artificial Sequence
  Description of Artificial Sequence: Synthetic polypeptide
  MOD_RES (9)..(9): Any amino acid
  MOD_RES (31)..(31): Any amino acid
QGHLVQSGXEVKKPGSSVKVSCKASGGTFSXYAIGWVRQAPGQGLEWMGGIIPILGTTNYAQRFQGGVTITADESTNTAYMDVSSLRSDDTAVYYCAKAPYRPRGSGNYYYAMDVWGQGTTVIVSSASTS

SEQ ID NO: 8054 - protein, 131 aa, Artificial Sequence
  Description of Artificial Sequence: Synthetic polypeptide
QVQLQQWGSGLLKPSETLSLTCAVYGGSFRSYYWNWIRQSPGKGLEWIGEVSHSGSTNYNPALKSRVTISVDTSKNQFSLKVKSVTAADTALYYCSRGRGKRCSGAYCFAGYFDSWGQGGLVVVSSASTKG

SEQ ID NO: 8055 - protein, 129 aa, Artificial Sequence
  Description of Artificial Sequence: Synthetic polypeptide
QGHLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 8056 - protein, 132 aa, Artificial Sequence
  Description of Artificial Sequence: Synthetic polypeptide
EVQLVESGGGVVEPGESLRLSCAASGFTFRSYDMFWVRQATGKSLEWVSAIGIAGDTYYSGSVKGRFTISRENARTSLYLQLSGLRVEDSAVYFCVRGSPPRIAATEYNYYYGLDVWGQGTTVSVFSASTKG

SEQ ID NO: 8057 - protein, 138 aa, Artificial Sequence
  Description of Artificial Sequence: Synthetic polypeptide
VVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 8058 - protein, 138 aa, Artificial Sequence
  Description of Artificial Sequence: Synthetic polypeptide
QVQLVQSGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG

SEQ ID NO: 8059 - protein, 125 aa, Artificial Sequence
  Description of Artificial Sequence: Synthetic polypeptide
EVQLVESGGGLVKPGGSLRLSCAASGFSFSEHYMSWIRLAPGKGLEWLSYISSSTRTTYSADSVRGRFTISRDTAKQLLFLHMSSLRAEDTAVYYCVRLYGGINGWFDQWGQGTLVSVSSASTKG

SEQ ID NO: 8060 - protein, 123 aa, Artificial Sequence
  Description of Artificial Sequence: Synthetic polypeptide
QVQLVQSGAEVKKPGSSVKVSCKTSGGSFSNYAFSWVRQAPGEGLEWMGRIIPIFGTAKYTQKLQGRVTITADKFTSTVYMELSSLRSEDTAIYYCASLHQGPIGYTPWHPPPRAPLGQSVCG

SEQ ID NO: 8061 - protein, 139 aa, Artificial Sequence
  Description of Artificial Sequence: Synthetic polypeptide
QVQLVESGAEVKKPGASVKVSCKASGYTFTSHDINWVRQATGQGLEWMGWMNPNSGDTGYAHKFQGRVTMTRNTPISTAYMELSSLRSEDTAVYYCARGRATSRNTPWAHYYDSSGYYGAGDYWGQGTLVTVSSASTKG

SEQ ID NO: 8062 - protein, 133 aa, Artificial Sequence
  Description of Artificial Sequence: Synthetic polypeptide
QVQLVESGGGVVQPGRSLRLFCAASGFAFNTYGMHWVRQAPGKGLEWVAVTWHDGSQKYYADSVKGRFTISRDNSKNTLYLQMNSLRAEDTAIYYCASDQGGFDDSSGYFAPGGMDVWGRGTTVIVSSAPTKG

SEQ ID NO: 8063 - protein, 121 aa, Artificial Sequence
  Description of Artificial Sequence: Synthetic polypeptide
QVQLVESGAELRKPGESLEISCKASGYSFSSHWIGWARQMPGKGLEWMGIIYPGDSNTIYSPSFQGQVTISADKSINTAYLQWSSLKASDTAMYFCASNYHDYFYWGQGTLVTVSSASTKG

SEQ ID NO: 8064 - protein, 135 aa, Artificial Sequence
  Description of Artificial Sequence: Synthetic polypeptide
EVQLVESGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 8065 - protein, 138 aa, Artificial Sequence; identical to SEQ ID NO: 8058
  Description of Artificial Sequence: Synthetic polypeptide

SEQ ID NO: 8066 - protein, 129 aa, Artificial Sequence
  Description of Artificial Sequence: Synthetic polypeptide
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG

SEQ ID NO: 8067 - protein, 135 aa, Artificial Sequence
  Description of Artificial Sequence: Synthetic polypeptide
EVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 8068 - protein, 143 aa, Artificial Sequence
  Description of Artificial Sequence: Synthetic polypeptide
QVFVQLVQSGGGLVQPGGSVRLSCTASGFLFSTYSMNWVRQAPGKGLEWVSSISTTSNYIYYADSVKGRFTISRSNGQGSLYLQLNSLRVEDTAVYYCARDTKVGAPRQDCYAMDLWGQRDHGHRLLSFHQGPIGLPPGALLQ

SEQ ID NO: 8069 - protein, 129 aa, Artificial Sequence
  Description of Artificial Sequence: Synthetic polypeptide
QVQLLESGPGLVTPSGTLSLACAVSGASISSSHWWTWVRQSPGKGLEWIGEIDRRGTTNYNPSLRSRVTILLDNSKNQFSLSLRSVTAADTAVYYCTKVYAGLFNERTYGMDVWGHGTTVLVSSASTKG

SEQ ID NO: 8070 - protein, 138 aa, Artificial Sequence
  Description of Artificial Sequence: Synthetic polypeptide
QVQLVESGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 8071 - protein, 129 aa, Artificial Sequence
  Description of Artificial Sequence: Synthetic polypeptide
QGHLVQSGGGVKKLGTSVTISCLVSEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 8072 - protein, 132 aa, Artificial Sequence
  Description of Artificial Sequence: Synthetic polypeptide
QVQLLQSGAEVKKPGASVKVSCKVSGYTLTELSINWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 8073 - protein, 227 aa, Artificial Sequence
  Description of Artificial Sequence: Synthetic polypeptide
QGQLVQSGGGLKKPGTSVTISCLASEYTFNEFVIHWIRQAPGQGPLWLGLIKRSGRLMTAYNFQDRLSLRRDRSTGTVFMELRGLRPDDTAVYYCARDGLGEVAPDYRYGIDVWGQGSTVIVTSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSC

SEQ ID NO: 8074 - protein, 129 aa, Artificial Sequence
  Description of Artificial Sequence: Synthetic polypeptide
QGQLVQSGGGLKKPGTSVTISCLASEYTFNEFVIHWIRQAPGQGPLWLGLIKRSGRLMTAYNFQDRLRLRRDRSTGTVFMELRGLRPDDTAVYYCARDGLGEVAPDYRYGIDVWGQGSTVIVTAASTKG

SEQ ID NO: 8075 - protein, 131 aa, Artificial Sequence
  Description of Artificial Sequence: Synthetic polypeptide
QVQLVQSGTEVQKPGASVKVSCKTSGYTFSKYYIHWVRQAPGQGLEWVGRINTDSGGTDYAEKFQGRVTMTRDTSITTVYLEMRGLTSDDTAAFYCARGPPHAGGWTIYYYGLDVWGQGTSVIVSSASTKG

SEQ ID NO: 8076 - protein, 132 aa, Artificial Sequence
  Description of Artificial Sequence: Synthetic polypeptide
QVQLVQSGAEVKKPGASVKVSCKVSGHTLSELSINWVRHVPGKGLEWMGGLDPEDGEAIHEPKFQGRLTMTEDTSTDTAYVELSSLRSEDTAMYYCATADPFKVAQDEGLYVIFDYWGQGTLVTVSSASTKG

SEQ ID NO: 8077 - protein, 229 aa, Artificial Sequence
  Description of Artificial Sequence: Synthetic polypeptide
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSTVIVTSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDK

SEQ ID NO: 8078 - protein, 129 aa, Artificial Sequence
  Description of Artificial Sequence: Synthetic polypeptide
QGQLVQSGGGVKKPGTSVTISCLASEYTFNEFVIHWIRQAPGQGPVWLGLIKRSGRLMTSYKFQDRLSLRRDRSTGTVFMELRGLRLDDTAVYYCARDGLGEVAPAYLYGIDAWGQGSTVIVTSASTKG

SEQ ID NO: 8079 - protein, 126 aa, Artificial Sequence
  Description of Artificial Sequence: Synthetic polypeptide
EVQLVESGGGVVQPGRSLRLSCAASGFTFSHHGIHWVRQAPGEGLEWVAVISEDGTNIHYEDSVRGRFTISRDNSKNTVDLQMNSLRAEDTAVYYCASLISMRDGDAFDLWGQGTRVTVSSASTKG

SEQ ID NO: 8080 - protein, 138 aa, Artificial Sequence
  Description of Artificial Sequence: Synthetic polypeptide
QVQLVQSGAEVRKPGSSLKVSCKSSGGTFSRYVVNWVRQAPGQGLEWMGGIIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 8081 - protein, 124 aa, Artificial Sequence
  Description of Artificial Sequence: Synthetic polypeptide
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCAREGSYYYGMDVWGQGTTVTVSSASTKG

SEQ ID NO: 8082 - protein, 129 aa, Artificial Sequence
  Description of Artificial Sequence: Synthetic polypeptide
QGQLVQSGGGVKKPGASVTISCLASEYTFNEFVIHWIRQAPGQGPLWLGLIKRSGRLMTAYKFQDRLSLRRDRSTGTVFMELRGLRPEDTAVYYCARDGLGEVAPDYRYGIDVWGQGSTVIVSAASTKG

SEQ ID NO: 8083 - protein, 130 aa, Artificial Sequence
  Description of Artificial Sequence: Synthetic polypeptide
EVQLVQSGGGLVQPGRSLRLSCAASGFTFDDYAMHWVRQAPGKGLEWVSGISWNSGTIGYADSVRGRFTISRDDAKSSLYLQMNSLRTEDTALYYCAKDGWVGSGSSTLRGSDYWGQGTLVTVSSASTKG

SEQ ID NO: 8084 - protein, 157 aa, Artificial Sequence
  Description of Artificial Sequence: Synthetic polypeptide
QIHLVQSGTDVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSRGQGTLISVSAASTKGPSVFPLAPSSKSTYGLAHVL

SEQ ID NO: 8085 - protein, 138 aa, Artificial Sequence; identical to SEQ ID NO: 8058
  Description of Artificial Sequence: Synthetic polypeptide

SEQ ID NO: 8086 - protein, 125 aa, Artificial Sequence
  Description of Artificial Sequence: Synthetic polypeptide
QLQLQESGPGLVKPWETLVLTCSVSGGSISSGDYYWGWIRQSPGKGPEWIGNIFYSSGNTYYNTSLKSRVTISVDVSKNRFSLKLTSMTAADTAVYYCGRLSNKGWFDPWGQGTLVSVSSASTKG

SEQ ID NO: 8087 - protein, 127 aa, Artificial Sequence
  Description of Artificial Sequence: Synthetic polypeptide
QVQLLESGGGLVQRGGSLRLSCTASGFVFNNYWMTWVRQAPGNGLEWVANIDQDGSEKHYLDSVKGRFTISRDNAKNSLYLQMNSLRAEDTAIYYCARVRFKVTAWHRFDSWGQGDLVTVSSTSTKG

SEQ ID NO: 8088 - protein, 132 aa, Artificial Sequence
  Description of Artificial Sequence: Synthetic polypeptide
LVQLLQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 8089 - protein, 126 aa, Artificial Sequence
  Description of Artificial Sequence: Synthetic polypeptide
QVQLVESGGGLGQPGGSLRLSCAASGFTFRNYAMSWVRQAAGKGLEWVSGVSGGGDTTYYGDSVKGRFTISRDNSKNTLYLQMNNLRAEDTAVYYCAKDKGVWGSSDFDYWGQGTLVTVSSASTKG

SEQ ID NO: 8090 - protein, 132 aa, Artificial Sequence
  Description of Artificial Sequence: Synthetic polypeptide
QVHLVQSGAEVKKPGASVRVSCKASGYTFTTYGISWVRQAPGQGLEWMGWISAHSGDTNYAQKLQARVTMTTDTSTNTAYMELRSLTSDDTAVYYCARDRPRHYYDRGGYYSPFDYWGQGTLVTVSSASTKG

SEQ ID NO: 8091 - protein, 139 aa, Artificial Sequence
  Description of Artificial Sequence: Synthetic polypeptide
QVQLVESGAEVKKPGSSVKVSCKASGGTFNIFAFSWVRQAPGQGLEWMGGIIPIFASPNYAQRFQGRVTITADESTSTVHMELSSLRSEDTAIYYCAKDAHMHIEEPRDYDYIWGTSPYYFDYWGQGTLVTVSSASTKG

SEQ ID NO: 8092 - protein, 132 aa, Artificial Sequence
  Description of Artificial Sequence: Synthetic polypeptide
QVQLVQSGAEVKKPGASVKVSCKVSGYTLTELSIHWVRQAPGKGLEWMGGFDSEDGEAFYKQNFQGRVTMTEDTSTDTAYMELRRLRSEDTAVYYCATADRFKVAQDEGLFVIFDYWGQGTLVTVSSASTKG

SEQ ID NO: 8093 - protein, 132 aa, Artificial Sequence
  Description of Artificial Sequence: Synthetic polypeptide
QVQLLQSGGEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 8094 - protein, 135 aa, Artificial Sequence
  Description of Artificial Sequence: Synthetic polypeptide
EVQLVESGGGLVQPGGSLRLSCAASGFTFSSYSMNWVRQAPGKGLEWVSYISGSSYTIYYADSVRGRFTISRDNAKNSLYLQMNSLRDEDTAVYFCARATPPNPLNLYNYDSSGSSFDYWGQGTLVTVSSASTKG

SEQ ID NO: 8095 - protein, 138 aa, Artificial Sequence
  Description of Artificial Sequence: Synthetic polypeptide
QVQLVQSGAEVRKPGSSLKVSCKSSGGTFSRYVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 8096 - protein, 138 aa, Artificial Sequence
  Description of Artificial Sequence: Synthetic polypeptide
QVQLVESGAEVRKPGSSLKVSCKSSGGTFSRYVVNWVRQAPGQGLEWMGGIIPIFGIAKYAQKFQDRVTMTADEPKNTVYLDFNSLRSDDTAVYYCARDRGDTRLLDYGDYEDERYYYGMDVWGQGTTVIVSSASTKG

SEQ ID NO: 8097 - protein, 124 aa, Artificial Sequence
  Description of Artificial Sequence: Synthetic polypeptide
QVQLVQSGAEIKKPGESLKISCKASGYTFNDYWIGWVRQMPGKGLEWMGIFYPDDSDSNYSPSFQGRVTISADKSITTAYLQWSTLKASDSAMYFCARLLGDSGAFDIWGQGTMVIVSSASTKG

SEQ ID NO: 8098 - protein, 138 aa, Artificial Sequence
  Description of Artificial Sequence: Synthetic polypeptide
EVQLVESGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 8099 - protein, 135 aa, Artificial Sequence
  Description of Artificial Sequence: Synthetic polypeptide
QVQLVQSGAEVKKPGSSVKVSCKASGGTFSTYAFSWVRQAPGQGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 8100 - protein, 138 aa, Artificial Sequence
  Description of Artificial Sequence: Synthetic polypeptide
QVQLVQSGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 8101 - protein, 126 aa, Artificial Sequence
  Description of Artificial Sequence: Synthetic polypeptide
QVQLVQSGGGVVQPGRSLRLSCAASGFTFSHHGIHWVRQAPGEGLEWVAVISEDGTNIHYEDSVRGRFTISRDNSKNTVDLQMNSLRAEDTAVYYCASLISMRDGDAFDLWGQGTRVTVSSASTKG

SEQ ID NO: 8102 - protein, 133 aa, Artificial Sequence
  Description of Artificial Sequence: Synthetic polypeptide
EVQLVQSGGGLVKPGGSLRLSCAASGFTFKNAWMSWVRQAPGKGLEWVGHIKSKTDGGTIDYAAPVKGRFTISRDDSKNTLYLQMNSLKIEDTAVYYCTTDIGSGRGWDFHYYDSNDWGQGTLVTVSSASTKG

SEQ ID NO: 8103 - protein, 131 aa, Artificial Sequence
  Description of Artificial Sequence: Synthetic polypeptide
EVQLVQSGGGVVQPGRSLRLSCVVSGFTFSSFTFHWVRQAPGKGLEWVAGMSFHATYIYYADSVKGRFTISRDDSQDTLYLEMDSLRSEDTAIYYCARDPGIHDYGDYAPGAFDYWGQGSPVTVSSASTKG

SEQ ID NO: 8104 - protein, 132 aa, Artificial Sequence
  Description of Artificial Sequence: Synthetic polypeptide
LVQLVQSGAEVKKPGASVKVSCKVSGHTLSELSINWVRHVPGKGLEWMGGLDPEDGEAIHEPKFQGRLTMTEDTSTDTAYSTLSVWAPVAAAMYYCATADPFKVAQDEGLYVIFDYWGQGTLVTVSSASTKG

SEQ ID NO: 8105 - protein, 125 aa, Artificial Sequence
  Description of Artificial Sequence: Synthetic polypeptide
EVQLVESGAEVKKPGSSVKVSCKASGGTFSSYSISWVRQAPGQGLEWMGGIIPIFATTHYGQKFQGRIKITADKSTSTAYMELSRLRSEDTAVYYCARDREFYFYGMDVWGQGTTVTVSSASTKG

SEQ ID NO: 8106 - protein, 131 aa, Artificial Sequence
  Description of Artificial Sequence: Synthetic polypeptide
QVQLQQWGAGLLKPSETLSLTCAVYAGSFSGYYWTWIRQPPGKGLEWIGEVNHGGSTNYNPSLKSRVTLSVDTSKNQFSLKLTSVTAADTAVYYCARVSRYDFWSGNYGSYGLDVWGQGTTVTVSSASTKG

SEQ ID NO: 8107 - protein, 137 aa, Artificial Sequence
  Description of Artificial Sequence: Synthetic polypeptide
WQLVQSGAEVRKPGSSLKVSCKSSGGTFSRFVVNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 8108 - protein, 154 aa, Artificial Sequence
  Description of Artificial Sequence: Synthetic polypeptide
LVQLVQSGAEVKKPGASVKVSCKVSGYSLTELSIHWVRQAPGKGLEWMGGFDSEDGEAIYKQNFQGRVTMTEDTSTDTAYMELSRLRSEDTAVYYCATADPFKVAQDEGLFVIFDYWGQGTTGHRLLSLHQGPHRLYSLGTLLSRAPIVQTHMA

SEQ ID NO: 8109 - protein, 135 aa, Artificial Sequence; identical to SEQ ID NO: 8099
  Description of Artificial Sequence: Synthetic polypeptide

SEQ ID NO: 8110 - protein, 135 aa, Artificial Sequence
  Description of Artificial Sequence: Synthetic polypeptide
QVQLVQSGAEVKKPGSSVKVSCKASGGTFSTYAFSWVRQAPIEGLEWMGGIIPIFGTENYAQKFQGRVTITADKSTSTAYMELSSLRSEDTAVYYCARDRSSAIGYCSSISCYKGSFDIWGQGTMVTVSSASTKG

SEQ ID NO: 8111 - protein, 129 aa, Artificial Sequence; identical to SEQ ID NO: 8055
  Description of Artificial Sequence: Synthetic polypeptide

SEQ ID NO: 8112 - protein, 132 aa, Artificial Sequence
  Description of Artificial Sequence: Synthetic polypeptide
QVQLVQWGAGLLKPLETLSLTCAVYGGSFNGYFWSWIRQTPGKGLEWIGEINHGGSANFNPSLKSRVTMSVDTSKNQFSLKLASVTAADTAIYYCARGRITMVRGDPQRGGVRMDVWGQGTSVTVSSASTKG

SEQ ID NO: 8113 - protein, 132 aa, Artificial Sequence
  Description of Artificial Sequence: Synthetic polypeptide
QVQLMQSGAEVKRPGASVKVSCKAFRHSLNNLGISWIRRAPGRGLEWLGWINVYEGNTKYGRRFQGRVTMTTDRSTNTVSMELRSLTSDDTAVYYCARDNHFWSGSSRYYYFGMDVWGQGTTVIVSSASTKG

SEQ ID NO: 8114 - protein, 125 aa, Artificial Sequence
  Description of Artificial Sequence: Synthetic polypeptide
QVQLVQSGGGLVQPGESLRLSCTASGFTFSSYNMNWVRQAPGKGLEWISYISDKSKNKYYADSVRGRFTISRDNAQNSLFLQMSSLRDEDTAVYYCTREGPQRSFYFDYWGQGIQVTVSSASTKG

SEQ ID NO: 8115 - protein, 126 aa, Artificial Sequence
  Description of Artificial Sequence: Synthetic polypeptide
QVQLQESGPGLVKPSETLSLTCTVSGGSISNHYWSWIRQPPGKGLEWIGYIYHSGNINYKSSLKSRATISIDTSNNQFSLKLSSVIAADTAVYYCARNFGPGSPNYGMDVWGQGTTVTVSSASTKG

SEQ ID NO: 8116 - protein, 130 aa, Artificial Sequence
  Description of Artificial Sequence: Synthetic polypeptide
VVQLVQSGPGLVKPSQTLSLTCTVSGGSISSGDFYWSWIRQPPGKGLEWIGYIYYSGSTYYNPSLKSRLTISVDTSKNQFSLRLSSVTAADTAVYYCARDLNSRIVGALDAFDIWGQGTMVTVSSASTKG

SEQ ID NO: 8117 - protein, 129 aa, Artificial Sequence
  Description of Artificial Sequence: Synthetic polypeptide
QVQLVESGGALVQPGGSLRLSCAASGFSFSSYAMSWVRQAPGKGLEWVSAISRSGGSTYYADSVKGRFTISIDNSNNTLYLQMNSLRVEDTAVYYCAKREAFYYGAGGYGMDVWGQGTTVTVSSASTKG

SEQ ID NO: 8118 - protein, 130 aa, Artificial Sequence
  Description of Artificial Sequence: Synthetic polypeptide
EVQLVESGGGLVKPGGSLRLSCEASGFTFTNAWMNWVRQAPGKGLEWVGRIKSQTHGGTTRYAAPVKGRFTISRDDSKHTLYLQMDRLTTEDTAVYYCTGTITGSTFYYYGMDVWGQGTTVTVSPASTKG

SEQ ID NO: 8119 - protein, 132 aa, Artificial Sequence
  Description of Artificial Sequence: Synthetic polypeptide
EVQLVESGGGLLQPGGSLRLSCAASGFSFNDFEMNWVRQAPGKGLEWVSYISNDGTMIHYADSVKGRFTISRDNAKKSLFLQMNSLRAEDTAVYYCARLAEVPPAIRGSYYYGMDVWGQGTTVTVASASTKG

SEQ ID NO: 8120 - protein, 132 aa, Artificial Sequence
  Description of Artificial Sequence: Synthetic polypeptide
GVHFQGHLVQSGGGVKKPGSSVTISCLASEYTFTEFTIHWIRQAPGQGPLWLGLIKRSGRLMTSYRFQDRLSLRRDRSTGTVFMELRGLRIDDTAVYYCARDGLGEVAPAYLYGIDVWGQGSTVIVTSASTS

SEQ ID NO: 8121 - protein, 123 aa, Artificial Sequence
  Description of Artificial Sequence: Synthetic polypeptide
QVQLQESGPGLLRPLETLSLTCSVSGGSIRGYFWSWVRQPAGRGLEWIGRIYSSGTTRFNPSLKSRVRLSIDTAKSEVSLNITSVTAADSASYFCAGTSPVHGGLDLWGLGLRVTVSSASTKG

SEQ ID NO: 8122 - protein, 135 aa, Artificial Sequence
  Description of Artificial Sequence: Synthetic polypeptide
HLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDQWSGLHHDGVMAFSSWGQGTLISVSAASTKG

SEQ ID NO: 8123 - protein, 129 aa, Artificial Sequence
  Description of Artificial Sequence: Synthetic polypeptide
QGQLVQSGGGVKKPGTSVTISCLASEYTFTEFTIHWIRQAPGQGPLWLGLIKRSGRLMTAYRFQDRLSLRRDRSTGTVFMELRNLRMDDTAVYYCARDGLGELAPAYQYGIDVWGQGTTVIVSSASTKG

SEQ ID NO: 8124 - protein, 132 aa, Artificial Sequence
  Description of Artificial Sequence: Synthetic polypeptide
EVQLVQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 8125 - protein, 129 aa, Artificial Sequence
  Description of Artificial Sequence: Synthetic polypeptide
QVQLVESGGGLVQPGGSLRLSCAASGFTFSTHWMHWVRQAPGKGLVWVSRIHSDGRSTSYADSVKGRFTISRDNAKNTLYLQMNSLRAEDTAVYYCARGAAVFGVVIIGGMDLWGQGTTVTVSSASTKG

SEQ ID NO: 8126 - protein, 127 aa, Artificial Sequence
  Description of Artificial Sequence: Synthetic polypeptide
EVQLVESGGGVVQPGGSLRLSCAASGFMFKNYAMHWVRQPPGKGLEWVAVIWYGGRDQNYADSVKGRFTISRDDSDNTLYLQMNSLRAGDTAVYFCARNSQVGRLMPAAGVWGQGTLVTVSSASTKG

SEQ ID NO: 8127 - protein, 123 aa, Artificial Sequence
  Description of Artificial Sequence: Synthetic polypeptide
EVQLVESGGGLIQRGGSLRLSCVASGFPVSDNHMSWVRQAPGKGLEWVSIIYSDGGTYYADSVKGRFTISRDNSKNTVYLQMNSLRATDTAVYYCARDPGFHYGLDVWGQGTTVTVSSASTKG

SEQ ID NO: 8128 - protein, 124 aa, Artificial Sequence
  Description of Artificial Sequence: Synthetic polypeptide
VVQLVESGGGLVQPGGSLRLSCAASGFAFRSYWMSWVRQAPGRGLEWVANIKQDGSEKYYADSVKGRFTISRDNTKNSLYLQMNSLRAEDTAVFYCASRGDRYGPIDYWGQGTLVTVSSASTKG

SEQ ID NO: 8129 - protein, 125 aa, Artificial Sequence
  Description of Artificial Sequence: Synthetic polypeptide
VVQLVESGTEVKKPGSSVKVSCKASGGTFSGSDISWVRQAPGQGLEWMGGIIPMFDIENHAEKFRGRLTITAVKSTGAAYMELSSLRSEDAAVYYCARSSGNYDFAYDIWGQGTRVIVSSASTKG

SEQ ID NO: 8130 - protein, 129 aa, Artificial Sequence; identical to SEQ ID NO: 8055
  Description of Artificial Sequence: Synthetic polypeptide

SEQ ID NO: 8131 - protein, 135 aa, Artificial Sequence; identical to SEQ ID NO: 8067
  Description of Artificial Sequence: Synthetic polypeptide

SEQ ID NO: 8132 - protein, 130 aa, Artificial Sequence
  Description of Artificial Sequence: Synthetic polypeptide
EVQLVQSGGGLVQPGGSLRLSCAASGLTFRNFAMSWVRQAPGKGLEWVSSISGSGGSTYYADSVKGRFTISRDNSKNTLYLQMNSLRGEDTAVYFCAKGVGYDILTGLGDAFDIWGQGTVVAVSSASTKG

SEQ ID NO: 8133 - protein, 137 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKG

SEQ ID NO: 8134 - protein, 125 aa, Artificial Sequence
  Description of Artificial Sequence: Synthetic polypeptide
VVQLVQSGTEVKKPGSSVKVSCKASGGTFSGSDISWVRQAPGQGLEWMGGIIPMFDIEDHAQKFRGRLTITADKSTGAAYMELSSLRSEDAAVYYCARSSGNYDFAFDIWGQGTRLIVSSASTKG

SEQ ID NO: 8135 - protein, 132 aa, Artificial Sequence
  Description of Artificial Sequence: Synthetic polypeptide
QVQLGESGGGLVEPGGSLRLSCAASGFLFSDYQMSWIRLAPGKGLEWISFISGFGSVYYADSVEGRFTISRDNARNSLYLQMNNLRAEDTAVYYCARAYGTGNWRGLYYYYYGMDVWGHGTTVTVSSASTKG

SEQ ID NO: 8136 - protein, 122 aa, Artificial Sequence
  Description of Artificial Sequence: Synthetic polypeptide
QLQLVESGGGVVQPGRSLRLSCAASGFTFSTYTMHWVRQAPGKGLEWVAVISYDGTNKYYADSVKGRFTISRDNSKNTLYLQMNSLRGEDTAVYYCARSPSYYFDYWGQGTLVTVSAASTKG

SEQ ID NO: 8137 - protein, 129 aa, Artificial Sequence
  Description of Artificial Sequence: Synthetic polypeptide
QGHLVQSGGGVKKLGTSVTISCLASEDTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 8138 - protein, 128 aa, Artificial Sequence
  Description of Artificial Sequence: Synthetic polypeptide
QVQLVQSGAEVKMPGASVKVSCKVSGYSLTELSIHWVRQAPGKRLEWMGGFDPEDDERIYAQKFQDRVTMTEDTSTDTAYMDLNSLRSEDTAVYYCTTGGLYCSSISCIMDVWGQGTTVIVSSASTKG

SEQ ID NO: 8139 - protein, 128 aa, Artificial Sequence
  Description of Artificial Sequence: Synthetic polypeptide
QVQLVQSGAEVKKPGASVKVSCKVSGYTLTELSIHWVRQAPGKRLEWMGGFDPEDGERIYAQKFQGRVTMTEDTSTDTAYMELNSLRSDDTAVYYCATGGLYCSSISCIMDVWGQGTTVTVSSASTKG

SEQ ID NO: 8140 - protein, 128 aa, Artificial Sequence
  Description of Artificial Sequence: Synthetic polypeptide
QVQLVQSGGGVKKPGTSASFSCRTSDDIYDNEFFDSAFMHWVRLIPGQRPEWMGWMNPRSGAVNYARQLQPRVSMYRDRDLSTAYMEFKSLTSADTGTYFCARKKRGDGFNLYFDLWGRGSQVIVSSA

SEQ ID NO: 8141 - protein, 126 aa, Artificial Sequence
  Description of Artificial Sequence: Synthetic polypeptide
QVQLVQSGSAMKKPGASVRVSCWTSEDIFDTTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSA

SEQ ID NO: 8142 - protein, 129 aa, Artificial Sequence
  Description of Artificial Sequence: Synthetic polypeptide
QGQLVQSGGGVKKLGTSVTIPCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 8143 - protein, 129 aa, Artificial Sequence
  Description of Artificial Sequence: Synthetic polypeptide
QGQLVQSGGGVKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVTSASTKG

SEQ ID NO: 8144 - protein, 129 aa, Artificial Sequence
  Description of Artificial Sequence: Synthetic polypeptide
QVQLVESGGGVVQPGRSLRLSCAASGFTFSSYAMHWVRQAPGKGLEWVAVISYDGSNKYYADSVKGRFTISRDDSKSTVYLQINSLRAADTAVYFCAREGGLRFLEWLFWGQGTLVTVSSGESSASTKG

SEQ ID NO: 8145 - protein, 126 aa, Artificial Sequence
  Description of Artificial Sequence: Synthetic polypeptide
EFQLVQSGGGLVKPGGSLRLSCTGSTFSFSSDDMNWVRQAPGKGLEWVSSMSDSGSHIYYADFVKGRFTISRDNAKKSLYLQMNSLRAEDTAVYYCAQSRPPQRLYGMDVWGQGTTVTVSSASTKG

SEQ ID NO: 8146 - protein, 132 aa, Artificial Sequence
  Description of Artificial Sequence: Synthetic polypeptide
QVQLVQSGAEVKKPGASVKVSCKVSGYTLTELSIHWVRQAPGKGLEWMGGFDPEDGEASFEPKFQGRLTMTEDTSTDTAYMELSSLRSEDTAVYYCATADPFKVAQDEGLYVIFDYWGQGTLVTVSSASTKG

SEQ ID NO: 8147 - protein, 124 aa, Artificial Sequence
  Description of Artificial Sequence: Synthetic polypeptide
QVQLVESGGGVVQPGKSLRLSCAASGFTFSTHAMHWVRQAPGKGLDWVAVISHDGDNQYYADAVKGRFTISRDDSRDTVFLQMNSLRTEDTGVYYCAADSSGSNWFDYWGQGILVTVSSASTKG

SEQ ID NO: 8148 - protein, 129 aa, Artificial Sequence; identical to SEQ ID NO: 8055
  Description of Artificial Sequence: Synthetic polypeptide

SEQ ID NO: 8149 - protein, 121 aa, Artificial Sequence
  Description of Artificial Sequence: Synthetic polypeptide
EPMFQPGQSGGVVVQSGESLHLSCEASGFKFASQMMHWVRHVPGRGLEWVALISWDGSGKLFADSVRGRFTIHRWNDRNSLYLDVKNVRPEDAAIYYCTRNGFDVWGQGILVTVSSASTKG

SEQ ID NO: 8150 - protein, 132 aa, Artificial Sequence
  Description of Artificial Sequence: Synthetic polypeptide
QVQLLQSGAEVKKPGASVKVSCKVSGYTLTELSIHWVRQAPGKGLEWMGGFDPEDDEAIYEPKFQGRLTMTEDTSTDTAYMELSSLRSEDTAVYYCATADPFKVAQDEGLYVIFDYWGQGTLVTVSSASTKG

SEQ ID NO: 8151 - protein, 131 aa, Artificial Sequence
  Description of Artificial Sequence: Synthetic polypeptide
QVHLQESGPRLVRSSETLSLTCSVPGGSIVNPITNYYWSWIRQSPRKGLQWIGDIYYTGTSSRNPSLDSRVSISMDVSRKQISLTLYSVTAADTAVHYCASQSLSWYRPSGYFESWGQGILVTVSSASTKG

SEQ ID NO: 8152 - protein, 129 aa, Artificial Sequence; identical to SEQ ID NO: 8055
  Description of Artificial Sequence: Synthetic polypeptide

SEQ ID NO: 8153 - protein, 129 aa, Artificial Sequence
  Description of Artificial Sequence: Synthetic polypeptide
QGQLVQSGGGVKKTGTSVTISCLASEYTFTEFTIHWIRQAPGQGPLWLGLIKRSGRLMTANRFQDRLSLRRDRSTGTVFMELRSLRIDDTAVYYCARDGLGELAPAYHYGIDVWGQGTTIIVTSASTKG

SEQ ID NO: 8154 - protein, 128 aa, Artificial Sequence
  Description of Artificial Sequence: Synthetic polypeptide
QVQLVQSGAEVKKPGSSMKVSCKSSGGTFSNHAISWVRQAPGKGLEWMGGIIPMSGTTNYLQKFQGRVTITADEFATTAYMELSSLTSEDTAVYYCARARADSHTPIDAFDIWGPGTRVIVSSASTKG

SEQ ID NO: 8155 - protein, 129 aa, Artificial Sequence; identical to SEQ ID NO: 8153
  Description of Artificial Sequence: Synthetic polypeptide

SEQ ID NO: 8156 - protein, 125 aa, Artificial Sequence
  Description of Artificial Sequence: Synthetic polypeptide
QVQLVQSGTEVKKPGSSVKVSCKASGGTFSDSDIAWVRQAPGQGLEWMGGITPMFDMAKSAQKFRGRLIITADKSTGTAYMELSSLRYEDAAVYFCARSSGNFEFAFEIWGQGTKIIVSLASTKG

SEQ ID NO: 8157 - protein, 128 aa, Artificial Sequence
  Description of Artificial Sequence: Synthetic polypeptide
QVQLVQSGAEVKKPGASVKVSCKASGYTFTSYDINWVRQATGQGLEWMGWMNPNSGNTGYAQTFQGRVTMTRNTSISTAYMELSSLRSEDTAVYYCARDRWLPQYYYYGMDVWGQGTTVTVSSASTKG

SEQ ID NO: 8158 - protein, 134 aa, Artificial Sequence
  Description of Artificial Sequence: Synthetic polypeptide
FVQLVESGGGLVQPGGSLRLSCAASGFNFNTYWMNWVRQAPGKGLEWVANMKEDGSEKYYVDSVKGRFTISRDNAKNSLYLQMNSLRAEDTAVYYCARNPESRCIVGRNRGWCRYFDLWGRGSLVTVSPASTKG

SEQ ID NO: 8159 - protein, 129 aa, Artificial Sequence; identical to SEQ ID NO: 8123
  Description of Artificial Sequence: Synthetic polypeptide

SEQ ID NO: 8160 - protein, 141 aa, Artificial Sequence
  Description of Artificial Sequence: Synthetic polypeptide
LVQLVESGGGVVQPGRSLRLSCAASGFTFSTYAMHWVRQAPGKGLEWVAVISYDGSNKFYADSVKGRFTISRDNSKNTLYLQMNSLRAEDTAVYYCARPKFLPGADIVVVVAATPFDYWGQGNPGHRLLSFHQGPIGLPPG

SEQ ID NO: 8161 - protein, 129 aa, Artificial Sequence
  Description of Artificial Sequence: Synthetic polypeptide
QGQLVQSGGGGKKLGTSVTISCLASEYTFNEFVIHWIRQAPGQGPLWLGLIKRSGRLMTSYQFQDRLSLRRDRSTGTVFMELRGLRVDDTAVYYCARDGLGEVAPAYLYGIDAWGQGTTVIVSSASTKG

SEQ ID NO: 8162 - protein, 120 aa, Artificial Sequence
  Description of Artificial Sequence: Synthetic polypeptide
PMFQPGQSGGVVVQSGESLHLSCEASGFKFASQMMHWVRHVPGRGLEWVALISWDGSGKLFADSVRGRFTIHRWNDRNSLYLDVKNVRPEDAAIYYCTRNGFDVWGQGILVTVSSASTKG

SEQ ID NO: 8163 - protein, 132 aa, Artificial Sequence; identical to SEQ ID NO: 8076
  Description of Artificial Sequence: Synthetic polypeptide

SEQ ID NO: 8164 - protein, 137 aa, Artificial Sequence
  Description of Artificial Sequence: Synthetic polypeptide
QVQLVQSGAEVRKPGSSLKVSCKSSGGTFSRFWNWVRQAPGQGLEWMGGMIPIFGIAKYAQKFQDRVTMTADESKNTVYLDFSSLRSDDTAVYYCARDRGDTRLLDYGDYEDERYYYGMDVWGQGTTVIVSSASTKG

SEQ ID NO: 8165 - protein, 126 aa, Artificial Sequence
  Description of Artificial Sequence: Synthetic polypeptide
LVQLVESGGGVVQPGKSLRLSCATSGFTFSTYGMHWVRQAPGKGLEWVAVIWYDGSYKYYADSVKGRFTISRDNSKNTLFLQMNSLRAEDTAMYYCGREMAVGGTKALDHWGQGTLVTVSSASTKG

SEQ ID NO: 8166 - protein, 118 aa, Artificial Sequence
  Description of Artificial Sequence: Synthetic polypeptide
QVQLVQSGAEAKRPGDSVKVSCKASGYTFTEYYIHWVRQTPGQGFEWMGIITPGAGNTTYAQKFQGRITVTRDTSAATVYMELSNLTSEDTAVYFCSRGVSFWGQGTLVTVSSASTKG

SEQ ID NO: 8167 - protein, 122 aa, Artificial Sequence
  Description of Artificial Sequence: Synthetic polypeptide
QVQMVASGGGLVKPGGSLRLSCEASGFTFSDYYMSWVRQAPGKGLEWISYITSGGNALYYADSVKGRFTISRDNAKNSLYLQMNSLRAEDTAVYYCARDLLHAHDFGRQGTLVTVSSASTKG

SEQ ID NO: 8168 - protein, 127 aa, Artificial Sequence
  Description of Artificial Sequence: Synthetic polypeptide
QVQLVESGGGVVQPGRSLRLSCATSGFTSKNYGVHWVRQAPGKGLEWVAVIWYDGSNKFYADSVKGRFTISRDRSKNMVYLQMNSLRVEDTAIYYCARDSVAFVLEGPIDYWGQGTLVTVSSASTKG

SEQ ID NO: 8169 - protein, 129 aa, Artificial Sequence
  Description of Artificial Sequence: Synthetic polypeptide
QVQLVQSGAEVKKPGASVKVSCKASGYTFTDYYIHWVRQAPGQGLEWMGWINPSTGGTNFVQKFLGRVTMTSDTSINTAYMELRRLKNDDAAIYYCATYSTRQFFHYYYVTDVWGQGTTVTVSSASTKG

SEQ ID NO: 8170 - protein, 134 aa, Artificial Sequence
  Description of Artificial Sequence: Synthetic polypeptide
QVQLVQSGAEVKKPGSSVKVSCRASGGSFGNYAINWVRQAPMQGLEWMGGIIPIFGTTNYAQNFRGRVTINADTFTNTVNMDLSSLRSEDTAVYYCGRSINAAVPGLEGVYYYYGMAVWGQGTTVTVSSASTKG

SEQ ID NO: 8171 - protein, 134 aa, Artificial Sequence
  Description of Artificial Sequence: Synthetic polypeptide
QVQLHQWGAGLLKPSDTLSLTCGILGVSPPGSLTGYYWTWIRQPPGKGLEWIGEVYHSGSTNYNPSLASRVTISMGTTKTQFSLRLTSVTAADSAVYYCASGKVWGITARPRDAGLDVWGQGTTVTVTSASTKG

SEQ ID NO: 8172 - protein, 126 aa, Artificial Sequence
  Description of Artificial Sequence: Synthetic polypeptide
EVQVVESGGGLVQPGGSLRLSCVASGFTFSEYWMSWVRQAPGKGLEWVATIKRDGSEESYVDSVKGRFTISRDNAKNSLYLQMNSLRAEDTAVYYCARVRDPNYNLHFDSWGQGTLVTVSSASTKG

SEQ ID NO: 8173 - protein, 122 aa, Artificial Sequence
  Description of Artificial Sequence: Synthetic polypeptide
QVQLVESGGGLIQPGGSLRLSCEASGFAVGDINYMSWVRQAPGKGLEWVSVLYSGGSSQYADSVKGRFTISRDNSRNTLYLQMDNLRAEDTAVYYCARGLRVYFDLWGQGILVTVSSASTKG

SEQ ID NO: 8174 - protein, 135 aa, Artificial Sequence; identical to SEQ ID NO: 8099
  Description of Artificial Sequence: Synthetic polypeptide

SEQ ID NO: 8175 - protein, 125 aa, Artificial Sequence
  Description of Artificial Sequence: Synthetic polypeptide
QVQLQESGPGLVKPSETLSLTCTVSGGSISSRSYYWGWIRQPPGKGLEWVGSIYYTGSTYYSPSLKSRVTISVDTSQNQFSLKLNSVTAADTAVYYCARQKGSGTSLLYWGQGTLVTVSSASTKG

SEQ ID NO: 8176 - protein, 129 aa, Artificial Sequence
  Description of Artificial Sequence: Synthetic polypeptide
QVQLVQSGSELKKPGASVKVSCKASGYTFTSYAINWVRQAPGQGLEWMGWINTNTGNPTYAQGFTGRFVFSLETSVSTAYLQINSLKAEDTAVYYCARDLLESRTYYNDIRDCWGQGTLVTVSSASTKG

SEQ ID NO: 8177 - protein, 123 aa, Artificial Sequence
  Description of Artificial Sequence: Synthetic polypeptide
QVQLQESGSGLVKPSGTLSLTCAVSNGPISSGNWWSWVRQTPEKGLEWIGEVYHSGSTNHNPSLKSRATILVDKSKNQFSLNLRSVTAADTAVYYCARVRGSWNFDYWGQGILVTVSSASTKG

SEQ ID NO: 8178 - protein, 159 aa, Artificial Sequence [sequence omitted]

SEQ ID NO: 8179 - protein, 138 aa, Artificial Sequence; identical to SEQ ID NO: 8080
  Description of Artificial Sequence: Synthetic polypeptide

SEQ ID NO: 8180 - protein, 135 aa, Artificial Sequence; identical to SEQ ID NO: 8099
  Description of Artificial Sequence: Synthetic polypeptide

SEQ ID NO: 8181 - protein, 127 aa, Artificial Sequence
  Description of Artificial Sequence: Synthetic polypeptide
QVHLEESGPGLVKTSQTLSLTCSVSSYSISRSGYFWTWIRQRPGKGLEWIGYIYFNGRTTYNPSLKSRITISRDTSHSQFSLTLNSLSAADTAVYYCGRCQDGLASRPIDFWGQGTLVTVSSASTKG

SEQ ID NO: 8182 - protein, 127 aa, Artificial Sequence
  Description of Artificial Sequence: Synthetic polypeptide
QVQLVESGGGVVQPGKSLRLSCAISGFLFNNYGGQWVRQAPGKGLEWVAAISYDGNNRYYADSAKGRFLISRDTPKNILYLQIYSLRLDDTAVYYCARDSVSKSYSAPPEFWGQGTVVTVSSASTKG

SEQ ID NO: 8183 - protein, 129 aa, Artificial Sequence
  Description of Artificial Sequence: Synthetic polypeptide
QGQLVQSGGGVKKPGTSVTISCLASEYTFNEFVIHWIRQAPGQGPLWLGLIKRSGRLMTSYKFQDRLNLRRDRSTGTVFMELRGLRPDDTAVYYCARDGLGEVAPDYRYGIDVWGQGSTVIVTAASTKG

SEQ ID NO: 8184 - protein, 134 aa, Artificial Sequence
  Description of Artificial Sequence: Synthetic polypeptide
QLQLQESGPGLVKPSETLSLTCSVSDGSINSNSYYWAWIRQSPGKGLEWIGSVYYFGGTYYSPSLKSRVTMSVDRSKNQFSLNVSSVTAADTAIYYCARHVRPYDRSGYPERPNWFDPWGRGTLVTVSSASTKG

SEQ ID NO: 8185 - protein, 125 aa, Artificial Sequence
  Description of Artificial Sequence: Synthetic polypeptide
RVQLVQSGAEVKKPGSSVTVSCKASGGSFSSYAISWVRQAPGQGLEWVGGVKVMFGTVHYSQKVQGRVTITADDSTGTSYLELSGLRSADTAVYYCARNAGAYFYPFDIWGQGTLIIVSSASTKG

SEQ ID NO: 8186 - protein, 136 aa, Artificial Sequence
  Description of Artificial Sequence: Synthetic polypeptide
QVQLVQSGAEVKKPGASVKVSCKASGYTFTRYHIHWVRHAPGQGLEWMGKINPSRASTKYAKKFQDRVTMTRDTSTSTVYMELSSLRGDDTAVYYCGREMGTFTLLGVVIDHYDFYPMDVWGQGTPVTVSSASTKG

SEQ ID NO: 8187 - protein, 138 aa, Artificial Sequence
  Description of Artificial Sequence: Synthetic polypeptide
QVQLVQSGAEVRKPGSSLKVSCKSSGGTFSRYVVNWVRQAPGQGLEWMGGIIPIFGIAKYAQKFQDRVTMTADESKNTVYLDFSSLRSGDTAVYYCARDRGDTRLLDYGDYEDERYYYGMDVWGQGTTVTVSSASTKG

SEQ ID NO: 8188 - protein, 124 aa, Artificial Sequence
  Description of Artificial Sequence: Synthetic polypeptide
QAGGGMKKPGASMTVSCKTADEDIFDAAYMHWVRQAPGQTFEWLGWMKPVTGAVNYARQFQGRVSFYRTRELGIAYMDLRDLKFDDTAVYYCARRLPSYYYDSSVMSGDYWGQGTLVTVSSAST

SEQ ID NO: 8189 - protein, 124 aa, Artificial Sequence
  Description of Artificial Sequence: Synthetic polypeptide
QSGGGVKKPGASASFSCRTSEDPFDNEFFDSEFMHWVRLTPGQRPEWMGWMNPRSGGVNYAGQFRPRMSMWRDRELSTAYMELRDLTFADTGLYFCARRKEDDYDWYYDLWGRGAHIIVSAAST

SEQ ID NO: 8190 - protein, 126 aa, Artificial Sequence
  Description of Artificial Sequence: Synthetic polypeptide
QSGLEVKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSAST

SEQ ID NO: 8191 - protein, 123 aa, Artificial Sequence
  Description of Artificial Sequence: Synthetic polypeptide
QSGSAMKKPGASVRVSCWTSEDIFDTTELIYWVRQAPGQGLEWIGWVKIVSGTVNFASLDFRNRISLSRDRDLFTAHMDIRGLTQGDTATYFCARQKFYAGGQGWYFDLWGRGTLIVVSSAST

SEQ ID NO: 8192 - protein, 120 aa, Artificial Sequence
  Description of Artificial Sequence: Synthetic polypeptide
QSGSGVKKLGASVRVSCWTSEDIFERTELIHWVRQAPGQGLEWIGWVKAVSGAVNYAQDFKGRVAMTRDTSINTAYMQLAGLRSDDTAVYFCARDGGTGPPRYFLYWGQGTLLTVSSAST

SEQ ID NO: 8193 - protein, 125 aa, Artificial Sequence
  Description of Artificial Sequence: Synthetic polypeptide
QAGGGMKKPGASMTVSCKTADEDVFDAAYMHWVRQAPGQTFEWLGWMKPVTGAVNYARKFQGRVSFYRTRELGIAYMDLRDPKFDDTAVYFCARKTKGDVSGDGRGFFFDLWGRGTRVIISSAST

SEQ ID NO: 8194 - protein, 123 aa, Artificial Sequence
  Description of Artificial Sequence: Synthetic polypeptide
EIVLTQSPATLSLSPGERATLSCRASQGLNFVVWYQQKRGQAPRLLIHAPSGRAPGVPDRFSARGSGTEFSLVISSVEPDDFAIYYCQEYSSTPYNFGPGTRVDRKRTVAAPSVFIFPPSDEQ

SEQ ID NO: 8195 - protein, 222 aa, Artificial Sequence
  Description of Artificial Sequence: Synthetic polypeptide
EVNLEESGGGLVQPGGSMKLSCVASGFTFSNYWMNWVRQSPEKGLEWVADIRLKSNNYATLYAESVKGRFTISRDDSKSSVYLQMNNLRAEDTGIYYCTRGAYYRYDYAMDYWGQGTSVTVSSAKTTPPSVYPLAPGSAAQTNSMVTLGCLVKGYFPEPVTVTWNSGSLSSGVHTFPAVLQSDLYTLSSSVTVPSSPRPSETVTCNVAHPASSTKVDKKIVP

SEQ ID NO: 8196 - protein, 230 aa, Artificial Sequence
  Description of Artificial Sequence: Synthetic polypeptide
QVQLVQSGAEVKKPGASVKVSCQASGYRFSNFVIHWVRQAPGQRFEWMGWINPYNGNKEFSAKFQDRVTFTADTSANTAYMELRSLRSADTAVYYCARVGPYSWDDSPQDNYYMDVWGKGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSC

SEQ ID NO: 8197 - protein, 234 aa, Artificial Sequence
  Description of Artificial Sequence: Synthetic polypeptide
EVQLSESGGGFVKPGGSLRLSCEASGFTFNNYAMGWVRQAPGKGLEWVSVTSAHGGSAYFGEFVKGRFTMSRDHFIDTVYLEMNRLTVEDTAVYYCVRVTFYHEGSGYYYRAGNYFDSWGQGTLVIVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 8198 - protein, 226 aa, Artificial Sequence
  Description of Artificial Sequence: Synthetic polypeptide
  MOD_RES (1)..(1): Any amino acid
XVRLVQSGNQVRKPGASVRISCEASGYKFIDHFIHWVRQVPGHGLEWLGWINPRGGGVNYSRSFQGKLSMTMTRDNFEETAYLDLSKLNPGDTAVYFCARGFAGYEWSFIWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 8199 - protein, 474 aa, Artificial Sequence
  Description of Artificial Sequence: Synthetic polypeptide
EVQVVESGGGVVQPGRSLRLSCTASGFTFSNFAMGWVRQAPGKGLEWVAFISSDGSNKNYGDSVKGRFTISRDNSKNTVFLQMNSLRVEDTALYYCAKDVGDYKSDEWGTEYYDISISYPIQDPRAMVGAFDLWGQGTMVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8200 - protein, 474 aa, Artificial Sequence
  Description of Artificial Sequence: Synthetic polypeptide
EVQLVESGGGVVQPGRSLRLSCAASQFSFGNYGMHWVRQAPGKGLEWVAAISFAGTKTNYADSVKGRFTISRDNSKNTVYLQMNSLRAEDTALYFCAKDIREYECEYWTSDYYDFGRPQPCIDSRGVVGTFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8201 - protein, 474 aa, Artificial Sequence
  Description of Artificial Sequence: Synthetic polypeptide
EVQLVESGGGVVQPGKSLRLSCAASRFSFNRYGMHWVRQAPGKGLEWVAAISYDGTDKYHADKVWGRFTISRDNSKNTLYLQMNSLRAEDTALYYCAKDLREDECEEWWSDYYDFGKQLPCRKSRGVAGIFDGWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8202 - protein, 474 aa, Artificial Sequence
  Description of Artificial Sequence: Synthetic polypeptide
EVQLVESGGGVVQPGKSLRLSCAASQFSFNRYGMHWVRQAPGKGLEWVAAISYDGTDKYHADKVWGRFTISRDNSKNTLYLQMNSLRAEDTALYYCAKDLREDECEEWWSDYYDFGKQLPCRKSRGVAGIFDKWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8203 - protein, 474 aa, Artificial Sequence
  Description of Artificial Sequence: Synthetic polypeptide
EVQLVESGGGVVQPGRSLRLSCAASHFSLSSYGMHWVRQAPGKGLEWVTGISFAGTKTYYGDSVRGRFTVSRDISKNTLFLQMNSLRPDDTAMYYCARDQRYYECEEWASDYYDFGREQPCLDPRGVVGIFDLWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8204 - protein, 475 aa, Artificial Sequence
  Description of Artificial Sequence: Synthetic polypeptide
EVQLIESGGGVVQPGRSLRLSCGASGFSFNNYGMHWVRQAPGKGLEWVAGISFAGIKKYYGTSVKGRFTISRDNSKNNFYLQMNSLRVEDTALYYCARDLRELECEEWTLYNYYDFGSRGPCVDPRGVAGSFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8205 - protein, 474 aa, Artificial Sequence
  Description of Artificial Sequence: Synthetic polypeptide
EVQLVESGGGVVQPGRSLRLSCVGSQFSFNRYGMHWVRQAPGKGLEWVAGISFDGTDRYHADNVWGRFTISRDNSKNTLYLQMSSLRAEDTALYYCAKDLREDECEEWWSDYYDFGKKLPCRKSRGVAGVFDKWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8206 - protein, 476 aa, Artificial Sequence
  Description of Artificial Sequence: Synthetic polypeptide
EVQLVESGGGVVQPGRSLTLSCAASQFTFSNYGMHWVRQAPGKGLEWVASVSNDGTKKYHGDSVWGRFTISRDNSKNTLFLQMSSLRAEDTAVYFCVRDQREDECEEWWSDYYDFGRELPCRKFRGLGLAGIFDIWGHGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8207 - protein, 476 aa, Artificial Sequence
  Description of Artificial Sequence: Synthetic polypeptide
EVQLVESGGGVVQPGRSLTLSCAASQFNFANYGMHWVRQAPGKGLEWVASISNDGTKKYHEESVWGRFTISKDNSKSTLFLQMNSLRIEDTALYFCVKDQREDECEEWWSDYYDFGRELPCRKSRGLGLAGIFDMWGHGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8208 - protein, 474 aa, Artificial Sequence
  Description of Artificial Sequence: Synthetic polypeptide
QAILVESGGGVVQPGRSLRLSCAASQFTFSGHGLHWVRQAPGKGLEWVASISFAGTKMDYADSVKGRFAISRDNSKNTLYLQMNSLRVEDTALYYCAKDMREYECEYWTSDYYDFGRPQPCIDRRGVVGIFDMWGQGTMVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8209 - protein, 473 aa, Artificial Sequence
  Description of Artificial Sequence: Synthetic polypeptide
EVQLVESGGGVVPPGKSLTLSCVASRFTFSAFGMHWVRQAPGKGLEWVASISFAGIKKYYADSVKGRFSISRDNSNTLFLQMNGLRGEDTGLYHCVKDMRELECEEWASDYYDFGKPQPCLDRRGVSGISAWWGPGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8210 - protein, 474 aa, Artificial Sequence
  Description of Artificial Sequence: Synthetic polypeptide
EVQLVQSGGGVVQPGRSLRLSCAAPYFEFGRYGFHWVRQAPGKGLEWVASISFAGRDYYHSPSVWGRFTISRDNSKNTLYLQMNSLRIEDTALYFCARDLRESECEEWESDYYDFGKKGPCVKPRGVAGGLDLWGQGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8211 - protein, 494 aa, Artificial Sequence
  Description of Artificial Sequence: Synthetic polypeptide
MGWSCIILFLVATATGVHSQVQLVESGGGVVQPGTSLRLSCAASQFRFDGYGMHWVRQAPGKGLEWVASISHDGIKKYHAEKVWGRFTISRDNSKNTLYLQMNSLRPEDTALYYCAKDLREDECEEWWSDYYDFGKQLPCAKSRGGLVGIADNWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8212 - protein, 476 aa, Artificial Sequence
  Description of Artificial Sequence: Synthetic polypeptide
EVQLVESGGGIVQPGRSLTLSCVASQFAFSHYGMHWVRQAPGKGLEWVASISRDETKKYHGDSVWDRFSISRDNSKNTLFLQMNSLRAEDTALYFCVRDQREDECEEWWSDYYDFGKELPCRKFRGLGLAGIFDVWGHGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8213 - protein, 476 aa, Artificial Sequence
  Description of Artificial Sequence: Synthetic polypeptide
QKQLVESGGGVVQPGRSLTLSCAASQFPFSHYGMHWVRQAPGKGLEWVASITNDGTKKYHGESVWDRFRISRDNSKNTLFLQMNSLRAEDTALYFCVRDQREDECEEWWSDYYDFGKELPCRKFRGLGLAGIFDIWGHGTMVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8214 - protein, 474 aa, Artificial Sequence
  Description of Artificial Sequence: Synthetic polypeptide
QVQLVESGGGVVQPGRSLRLSCAASGFTFSNYAMDWVRQAPGKGLEWVAVISSDGSNKNYADSVKGRFTISRDNSKNTLYLQMNSLRAEDTAVYYCAKDLGENKNDEWATDYYDLSIAYPVQDPRAVVGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8215 - protein, 474 aa, Artificial Sequence
  Description of Artificial Sequence: Synthetic polypeptide
QVQLVESGGGVVQPGRSLRLSCAASGFTFSNFAMGWVRQAPGKGLEWVAFISSDGSNKNYGDSVKGRFTISRDNSKNTLFLQMNSLRAEDTALYYCAKDVGEYKSDEWATDYYDLSIAYPIQDPRAMVGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8216 - protein, 474 aa, Artificial Sequence
  Description of Artificial Sequence: Synthetic polypeptide
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGESENEEWATDYYDFSIGYPGQDPRGVVGAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8217 - protein, 698 aa, Artificial Sequence
  Description of Artificial Sequence: Synthetic polypeptide
MNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASGGGGSGGGGSLEAEAAAKEAAAKEAAAKEAAAKALEGGGGSGGGGSQVQLVQSGGGVFKPGGSLRLSCEASGFTFTEYYMTWVRQAPGKGLEWLAYISKNGEYSKYSPSSNGRFTISRDNAKNSVFLQLDRLSADDTAVYYCARADGLTYFSELLQYIFDLWGQGARVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVWDVSHEDPEVKFNWYVDGVEVHNAKTKPREEQYNSTYRWSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYT

SEQ ID NO: 8218 - protein, 641 aa, Artificial Sequence
  Description of Artificial Sequence: Synthetic polypeptide
NRGVPFRHLLLVLQLALLPAATQGKKWLGKKGDTVELTCTASQKKSIQFHWKNSNQIKILGNQGSFLTKGPSKLNDRADSRRSLWDQGNFPLIIKNLKIEDSDYICEVEDQKEEVQLLVFGLANSDHLLQGQSLLLESPPGSSPSVQCRSPRGKNIQGGKLSVSQLELQDSGWCVLQNQKKVEFKIDIVVLAFQKASLEAEAAAKEAAAKEAAAKEAAAKALEQVQLVQSGGGVFKPGGSLRLSCEASGFFEYYWVRQAPGKGLEWLAYISKNGEYSKYSPSSNGRFISRDNAKNSVFLQLDRLSADDAVYYCARADGLYFSELLQYIFDLWGQGARVVSSASKGPSVFPLAPSSKSSGGAALGCLVKDYFPEPVVSWNSGALSGVHFPAVLQSSGLYSLSSWVPSSSLGQYICNVNHKPSNKVDKKVEPKSCDKHCPPCPAPELLGGPSVFLFPPKPKDLISRPEVICVWDVSHEDPEVKFNWYVDGVEVHNAKKPREEQYNSYRWSVLVLHQDWLNGKEYKCKVSNKALPAPIEKISKAKGQPREPQVYLPPSRDELKNQVSLCLVKGFYPSDIAVEWESNGQPENNYKPPVLDSDGSFFLYSKLVDKSRWQQGNVFSCSVHEALHNHYQKSLSLSPGK

SEQ ID NO: 8219 - protein, 473 aa, Artificial Sequence
  Description of Artificial Sequence: Synthetic polypeptide
MDWTWRVLFLVAAATGAHSQVQLVQSGGGVFKPGGSLRLSCEASGFTFTEYYMTWVRQAPGKGLEWLAYISKNGEYSKYSPSSNGRFTISRDNAKNSVFLQLDRLSADDTAVYYCARADGLTYFSELLQYIFDLWGQGARVTVSSASTKGPSVFPLAPSSKSTSGGTAALGCLVKDYFPEPVTVSWNSGALTSGVHTFPAVLQSSGLYSLSSWTVPSSSLGTQTYICNVNHKPSNTKVDKRVEPKSCDKTHTCPPCPAPELLGGPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8220 - protein, 226 aa, Artificial Sequence
  Description of Artificial Sequence: Synthetic polypeptide
EIQLEQSGAEVKKSGESLKISCQTSGYSFSDYWIGWVRQMPGKGLEWMGIFYPGDSDSRYSPSFEGQVTMSADRSTNTAHLQWSSLKPSDTALYYCARLGGDYEDSGADAFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 8221 - protein, 225 aa, Artificial Sequence
  Description of Artificial Sequence: Synthetic polypeptide
EVQLVESGGGLVKAGGSLRLSCGVSNFRISAHTMNWVRRVPGGGLEWVASISTSSTYRDYADAVKGRFTVSRDDLEDFVYLQMHKMRVEDTAIYYCARKGSDRLSDNDPFDAWGPGTVVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 8222 - protein, 224 aa, Artificial Sequence
  Description of Artificial Sequence: Synthetic polypeptide
EVQLVESGGGLVKAGGSLILSCGVSNFRISAHTMNWVRRVPGGGLEWVASISTSSTYRDYADAVKGRFTVSRDDLEDFVYLQMHKMRVEDTAIYYCARKGSDRLSDNDPFDAWGPGTVVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 8223 - protein, 222 aa, Artificial Sequence
  Description of Artificial Sequence: Synthetic polypeptide
QVQLVQSGGGLVQPGGSLRLSCAAFGFNFSSYVMHWVRQAPGQGLEYLSAISSDGETTYHANSVKGRFTSSRDNSKNTLFLQMGSLRTEDVAVYYCARDRYYETSGSNAFDVWGQGTMVVVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVE

SEQ ID NO: 8224 - protein, 584 aa, Artificial Sequence
  Description of Artificial Sequence: Synthetic polypeptide
MKYLLPTAAAGLLLLAAQPAMAQVQLQQWGPGLVKPSQTLSLSCTVSGGSSSSGAHYWSWIRQYPGKGLEWIGYIHYSGNTYYNPSLKSRITISQHTSENQFSLKLNSVTVADTAVYYCARGTRLRTLRNAFDIWGQGTTVTVSSGGGGSGGGGSGGGGSQSALTQPPSASGSPGQSVTISCTGTSSDVGGYNYVSWYQHHPGKAPKLIISEVNNRPSGVPDRFSGSKSGNTASLTVSGLQAEDEAEYYCSSYTDIHNFVFGGGTKVTVLGQPKANTSGGSGGGSGGGSGGGSGGGSGGGSGELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIKRTGGGGSGGGGSGGGGSVQLLEQSGAEVKKPGSSVQVSCKASGGTFSMYGFNWVRQAPGHGLEWMGGIIPIFGTTNYAQKFRGRVTFTADQATSTAYMELTNLRSDDTAVYYCARDFGPDWEGGDSYDGSGRGFFDFWGQGTLVNVSSAAAHHHHHHGAAEQKLISEEDLNGAA

SEQ ID NO: 8225 - protein, 137 aa, Artificial Sequence
  Description of Artificial Sequence: Synthetic polypeptide
QIHLVQSGTEVKKPGSSVAVSCKAYGVNTFGLYAVNWVRQAPGQSLEYIGQIWRWKSSASHDFRGRVIISAVDLTGSSPPISSLEIKNLTSDDTAVYFCTATSTPDYWSGLHHDGVMAFSSWGQGTLISVSAASTKG

SEQ ID NO: 8226 - protein, 137 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVLISAVDLTGPSPPISSLEIKNLTSDDTAVYFCTTTSTYDKWSGLHHDGVMAFSSWGQGTLISVSAASTKG

SEQ ID NO: 8227 - protein, 137 aa, Artificial Sequence; identical to SEQ ID NO: 7835
  Description of Artificial Sequence: Synthetic polypeptide

SEQ ID NO: 8228 - protein, 137 aa, Artificial Sequence
  Description of Artificial Sequence: Synthetic polypeptide
QIHLVQSGTEVKKPGSSVTVSCKAYGVNTFGLYAVSWVRQAPGQRLEYIGQIRRWKSSASHHFRGRVTVSAVDPTGSSPPISSLEIRDLTTDDTAVYFCTTTSTSDYWSGLHNERGTAFSSWGQGTLISVSAASTKG

SEQ ID NO: 8229 - protein, 137 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVIISAVDLTGSSPPISPLEIKNLTSDDTAVYFCTTTSTSDRWSGLHHDGVMAFSSWGQGTLISVSAASTKG

SEQ ID NO: 8230 - protein, 137 aa, Artificial Sequence
  Description of Artificial Sequence: Synthetic polypeptide
QIHLVQSGTEVKKPGSSVTVSCKAYEVNTFGLYAVNWVRQAPGQSLEYIGQIWRWKSSASHHFRGRVLISAVDLTGSSPPISSLEIKNVTSDDTAVYFCTTTSTHDKWSGLHHDGVMAFSSWGQGTLISVSAASTKG

SEQ ID NO: 8231 - protein, 137 aa, Artificial Sequence
  Description of Artificial Sequence: Synthetic polypeptide
QIHLVQSGTEVKKPGSSVTVSCKAYGVNTFGLYAVNWVRQAPGQGLEYIGQIWRWKSSASHHFRGRVLISAVDLTGSSPPISSLEIKNVTSDDTAVYFCTTTSTYDKWSGLHHDGVVAFSSWGQGTLISVSAASTKG

SEQ ID NO: 8232 - protein, 448 aa, Artificial Sequence
  Description of Artificial Sequence: Synthetic polypeptide
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 8233 - protein, 448 aa, Artificial Sequence
  Description of Artificial Sequence: Synthetic polypeptide
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 8234 - protein, 137 aa, Artificial Sequence
  Description of Artificial Sequence: Synthetic polypeptide
QIHLVQSGTEVKKPGSSVTVSCKAYGVNTFGLYAVNWVRQAPGQGLEYIGQIWRWKSSASHHFRGRVLISAIDLTGSSPPISSLEIKNVTSDDTAVYFCTTMSTYDKWSGLHHDGVMAFSSWGQGTLISVSAASTKG

SEQ ID NO: 8235 - protein, 136 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVLISAVDLTGSSPPISSLEIKLTSDDTAVYFCTTTSTYDRWSGLHHDGVMAFSSWGQGTLISVSAASTKG

SEQ ID NO: 8236 - protein, 136 aa, Artificial Sequence
  Description of Artificial Sequence: Synthetic polypeptide
QIHLVQSGTEVKKPGSSVTVSCKAYGVNTFGLYAVNWVRQAPGQGLEYIGQIWRWKSSASHHFRGRVLISAVDLTGSSPPISSLEIKVTSDDTAVYFCTTTSTYDEWSDLHHDGVMAFSSWGQGTLISVSAASTKG

SEQ ID NO: 8237 - protein, 136 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVLISAVDLTGSSPPISSLEIKLTSDDTAVYFCTTTSTYDKWSGLHHDGVMAFSSRGQGTLISVSAASTKG

SEQ ID NO: 8238 - protein, 137 aa, Artificial Sequence
  Description of Artificial Sequence: Synthetic polypeptide
QIHLVQSGTGVKKPGSSVTVSCKAYGVNTFGLYAVNWVRQAPGQGLEYIGQIWRWKSSASHHFRGRVLISAVDLTGSSPPITSLEIKNVTSDDTAVYFCTTTSTYDKWSGLYHDGVMAFSSWGQGTLISVSAASTKG

SEQ ID NO: 8239 - protein, 137 aa, Artificial Sequence
  Description of Artificial Sequence: Synthetic polypeptide
QIHLVQSGTEVKKPGSSVTVSCKAYGVNTFGLYAVNWVRQAPGQSLEYIGQIWRWKSSASHHFRGRVIISAVDLTGSSPPISSLEIKNLTSDDTAVYFCTTASTYDKWSGLHHDGVMAFSSWGQGTLISVSAASTKG

SEQ ID NO: 8240 - protein, 128 aa, Artificial Sequence; identical to SEQ ID NO: 8140
  Description of Artificial Sequence: Synthetic polypeptide

SEQ ID NO: 8241 - protein, 126 aa, Artificial Sequence; identical to SEQ ID NO: 8141
  Description of Artificial Sequence: Synthetic polypeptide

SEQ ID NO: 8242 - protein, 232 aa, Artificial Sequence
  Description of Artificial Sequence: Synthetic polypeptide
QVQLQESGPGVVKSSETLSLTCTVSGGSMGGTYWSWLRLSPGKGLEWIGYIFHTGHTNYNPSLEGRVSISVDTSEDQFSLRLRSVTAADTAVYFCASLPRGQLVNAYFRNWGRGTLVSVTAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKHHHHHH

SEQ ID NO: 8243 - protein, 100 aa, Artificial Sequence
  Description of Artificial Sequence: Synthetic polypeptide
EVQLAESGGGLVKPGGSLRLSCAASGFTFSNAWMTWVRQAPGKGLEWVGRIKSKTDGGTTDYAAPVKGRFTISRDDSKNTLYLQMNSLKTEDTAVYYCTT

SEQ ID NO: 8244 - protein, 132 aa, Artificial Sequence
  Description of Artificial Sequence: Synthetic polypeptide
QVQLVQSGPELMKPGSSVKVSCRASGDNFLTSTFNWLRQAPGQRLEWMGRFIPSLGLITSAPKFSDRLTITADQATLTAYMELTGLTSEDTALYYCARGLCRGGNCRLGPSGWLDPWGRGTQVTVSSASTKG

SEQ ID NO: 8245 - protein, 126 aa, Artificial Sequence
  Description of Artificial Sequence: Synthetic polypeptide
QVVLIQSGAEVKRPGSSVKVSCKASGGSFPITWVRQAPGHGLEWMGGINPFFGTTNYAQKFQGRVSITADESTSTTYLHLSDLRSEDTAVYFCARENREKWLVLRSWFAPWGQGTLVTVSSASTKG

SEQ ID NO: 8246 - protein, 123 aa, Artificial Sequence
  Description of Artificial Sequence: Synthetic polypeptide
EESGPGLVKPSQTLSLTCSVSGDSVSSGGYFWSWIRQHPTKGLECLGYVYYTGNTYYNPSLKSPPTIEVAMANNQVSLKLGSVTAADTAVYYCARIKRFRGGNYFDTWGHGLLVTVSSASTKG

SEQ ID NO: 8247 - protein, 150 aa, Artificial Sequence
  Description of Artificial Sequence: Synthetic polypeptide
LAQLEQSGGGVVKPGGSLRLPCAASGFTFIDYYMAWIRLAPGKGLEWLSYISKNGDYTKYSESLKGRFTISRDNAKNLVILQLNRLRADDTAIYFCARADGLTYFGELLQYIFDLWGQGARVIVSSASTKGPSVFPLAPSSKSTSGHASV

SEQ ID NO: 8248 - protein, 128 aa, Artificial Sequence
  Description of Artificial Sequence: Synthetic polypeptide
QVQLVQSGAEVKKPGASVKISCKASGYSFRNYAVHWVRQAPGQGLEWMGEINGGNGNTEYSQKSQGRLTITRDISATTAYMELSSLRSDDTAVYYCARVAYVHVVTTRSLDNWGQGTLVTVSSASTKG

SEQ ID NO: 8249 - protein, 139 aa, Artificial Sequence
  Description of Artificial Sequence: Synthetic polypeptide
QVQIRQSGPGLVKPLETLSLSCIVFGGSFIAYHWTWIRQAPLKGLEWIGDIDQGGDITYSPSLKSRVTMSVDRSKSQFSLKLSSVTAADAAVYYCVRGPPNRYAVTSFTSGTHRERSSYYFDYWGPGTLVTVSSASTKG

SEQ ID NO: 8250 - protein, 118 aa, Artificial Sequence
  Description of Artificial Sequence: Synthetic polypeptide
KAPATLSLSPGERATLSCRASQSVGSDLAWYQQKPGQAPRLLIYDASNRATAIPARFSGSGSGTDFTLSISSLEPEDFAVYFCQQRYDKITFGQGTRLEIQRTVAAPSVFIFPPSDEQ

SEQ ID NO: 8251 - protein, 121 aa, Artificial Sequence
  Description of Artificial Sequence: Synthetic polypeptide
FVQLVESGGGVVQPGTSLRLSCTTSGFIFSDYGMHWVRQAAGKGLEWVAVIWHDGSNRFYADSVKGRFTISRDNSKNAVYLEMNNLRVEDTALYYCARTSMDIDYWGQGTPVTVSSASTKG

SEQ ID NO: 8252 - protein, 132 aa, Artificial Sequence
  Description of Artificial Sequence: Synthetic polypeptide
QVYLVQSGPELKKPGASVKISCKASGYNFPKYAIHWVRQAPGQGLQWMGWINGDNGDARYSQKLQGRVTPSTDTSASVVYMELKRLRSEDTAVYYCARALYPWEIGGVPSTMGDDYWGQGTLITVSSASTKG

SEQ ID NO: 8253 - protein, 130 aa, Artificial Sequence
  Description of Artificial Sequence: Synthetic polypeptide
QVRLEQSGAAMRKPGASVTLSCQASGYNFVKYIVHWVRQKPGLGFEWVGMIDPYRGRPWSAHKFQGRLSLSRDTSMEILYMTLTSLTSDDTATYFCARAEAASDSHSRPIMFDHWGQGSRVTVSSASTKG

SEQ ID NO: 8254 - protein, 130 aa, Artificial Sequence
  Description of Artificial Sequence: Synthetic polypeptide
QVRLEQSGTAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 8255 - protein, 133 aa, Artificial Sequence
  Description of Artificial Sequence: Synthetic polypeptide
QVRLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 8256 - protein, 130 aa, Artificial Sequence
  Description of Artificial Sequence: Synthetic polypeptide
QVRLEQSGAAVRKPGASVTLSCQASGYNFVNYIIHWVRQRPGLDFEWVGMIDPYRGRPWSAHKFQGRLSLSRDVSTEILYMTLSSLRSDDTATYFCARAEAESQSHSRPIMFDFWGQGSRVTVSSASTKG

SEQ ID NO: 8257 - protein, 133 aa, Artificial Sequence
  Description of Artificial Sequence: Synthetic polypeptide
QVRLSQSGAAIKKPGASVTISCETEGYTFINYIIHWVRQPPGRGFEWLGMIDPRNGRPWFGQSVQGRLSLRRDTYTEVVYMTLSGLTSDDAGHYFCARNEPQYHDGNGHSLPGMFDYWGQGTLVAVSSASTKG

SEQ ID NO: 8258 - protein, 133 aa, Artificial Sequence
  Description of Artificial Sequence: Synthetic polypeptide
QVRLSQSGAAVKKPGASVTIVCETEGYNFIDYIIHWVRQPPGRGFEWLGMIDPRNGRPWSGQKVHGRLSLWRDTSTEKVYMTLTGLTSDDTGLYFCGRNEPQYHDDNGHSLPGMIDYWGQGTMVTVSSASTKG

SEQ ID NO: 8259 - protein, 133 aa, Artificial Sequence; identical to SEQ ID NO: 8255
  Description of Artificial Sequence: Synthetic polypeptide

SEQ ID NO: 8260 - protein, 133 aa, Artificial Sequence; identical to SEQ ID NO: 8255
  Description of Artificial Sequence: Synthetic polypeptide

SEQ ID NO: 8261 - protein, 133 aa, Artificial Sequence; identical to SEQ ID NO: 8255
  Description of Artificial Sequence: Synthetic polypeptide

SEQ ID NO: 8262 - protein, 130 aa, Artificial Sequence
  Description of Artificial Sequence: Synthetic polypeptide
QVRLEQSGAAVRKPGASVTLSCQASGYNFVRYIIHWVRQRPGLDFEWVGMIDPYRGRPWSAHKFGGRLSLTRDVSTEILYMTLTSLRSDDTATYFCARAEAESQSHSRPIMFDSWGQGSRVTVSSASTKG

SEQ ID NO: 8263 - protein, 130 aa, Artificial Sequence
  Description of Artificial Sequence: Synthetic polypeptide
QVRLEQSGNAVRKPGASVTISCQASGYNFVKFFIHWVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 8264 - protein, 130 aa, Artificial Sequence
  Description of Artificial Sequence: Synthetic polypeptide
QVRLEQSGAAMRKPGASVTLSCQASGYNFVKYIIHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 8265 - protein, 133 aa, Artificial Sequence
  Description of Artificial Sequence: Synthetic polypeptide
QVRLFQSGAAMRKPGASVTISCEASGYNFLNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 8266 - protein, 130 aa, Artificial Sequence; identical to SEQ ID NO: 8264
  Description of Artificial Sequence: Synthetic polypeptide

SEQ ID NO: 8267 - protein, 133 aa, Artificial Sequence
  Description of Artificial Sequence: Synthetic polypeptide
QVRLSQSGAAIKKPGASVTISCETEGYTFINYIIHWVRQPPGRGFEWLGMIDPRNGRPWFGQSVQGRLSLRRDTYTEVVYMTLSGLTSDDTGLYFCARNEPQYHDGNGHSLPGMFDSWGQGTLVAVSSASTKG

SEQ ID NO: 8268 - protein, 133 aa, Artificial Sequence
  Description of Artificial Sequence: Synthetic polypeptide
QVQLFQSGAAMRKPGASVTISCEASGYNFMNYFVHWVRQRPGRGFEWLGMINPRGGRPWSAQSVQGRLTLTRDTSTEMFYMRLDGLRSDDTATYFCARNEADYHDGNGHSLRGMFDYWGQGSLITVSSASTKG

SEQ ID NO: 8269 - protein, 130 aa, Artificial Sequence
  Description of Artificial Sequence: Synthetic polypeptide
QVRLEQSGAAMRKPGASVTLSCQASGYNFVKYIVHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 8270 - protein, 133 aa, Artificial Sequence
  Description of Artificial Sequence: Synthetic polypeptide
QVRLFQSGAAMKKPGASVTISCEASGYNFMNYFVHWVRQRPGRGFEWLGMINPRGGRPWSAQSVQGRLTLTRDISTEMFYMRLDGLRSDDTATYFCARNEADYHDGNGHSLRGMFDYWGQGSLITVSSASTKG

SEQ ID NO: 8271 - protein, 130 aa, Artificial Sequence
  Description of Artificial Sequence: Synthetic polypeptide
QVRLEQSGTAMRKPGASVTLSCQASGYNFVKYIVHWVRQKPGLGFEWVGMIDPYRGRPWSAHKFQGRLSLSRDTSMEILYMTLTSLKSDDTATYFCARAEAASDSHSRPIMFDHWGQGSRVTVSSASTKG

SEQ ID NO: 8272 - protein, 133 aa, Artificial Sequence; identical to SEQ ID NO: 8255
  Description of Artificial Sequence: Synthetic polypeptide

SEQ ID NO: 8273 - protein, 133 aa, Artificial Sequence; identical to SEQ ID NO: 8255
  Description of Artificial Sequence: Synthetic polypeptide

SEQ ID NO: 8274 - protein, 133 aa, Artificial Sequence; identical to SEQ ID NO: 8267
  Description of Artificial Sequence: Synthetic polypeptide

SEQ ID NO: 8275 - protein, 133 aa, Artificial Sequence; identical to SEQ ID NO: 8255
  Description of Artificial Sequence: Synthetic polypeptide

SEQ ID NO: 8276 - protein, 130 aa, Artificial Sequence; identical to SEQ ID NO: 8264
  Description of Artificial Sequence: Synthetic polypeptide

SEQ ID NO: 8277 - protein, 130 aa, Artificial Sequence; identical to SEQ ID NO: 8264
  Description of Artificial Sequence: Synthetic polypeptide

SEQ ID NO: 8278 - protein, 144 aa, Artificial Sequence
  Description of Artificial Sequence: Synthetic polypeptide
QVRLEQSGVAMRKPGASVTLSCQASGYNFVKYIIHWVRQKPGLGFEWVGMIDPYRGRPWSAHKFQGRLSLSRDTSMEILYMTLTSLKSDDTATYFCARAEAASDIHSRPIILTGPGEYGLDLEHMDWTWRILCLLAVAPGCHSQ

SEQ ID NO: 8279 - protein, 130 aa, Artificial Sequence; identical to SEQ ID NO: 8269
  Description of Artificial Sequence: Synthetic polypeptide

SEQ ID NO: 8280 - protein, 130 aa, Artificial Sequence
  Description of Artificial Sequence: Synthetic polypeptide
QVHLQQWGAGLLKPSETLSLTCAVSGGSFSGFFWTWIRQSPGKGLEWIGEVNHSGFTHSNPSLESRATISVAASNTQFSLRLASVTAADTAIYFCALRYFDWSPFRRDTYGTDVWGQGTTVIVSSASTKG

SEQ ID NO: 8281 - protein, 130 aa, Artificial Sequence
  Description of Artificial Sequence: Synthetic polypeptide
QVRLEQSGTAVRKPGASVTISCQASGYNFVKFFIHGVRQRPGQGFEWVGMIEPFRGRPWSAGNFQGRLSLSRDVSTETLYMTLNNLRSDDTAVYFCARLEAESDSHSRPIMFDHWGHGSLVTVSSASTKG

SEQ ID NO: 8282 - protein, 126 aa, Artificial Sequence
  Description of Artificial Sequence: Synthetic polypeptide
QVQLVQSGAELKKPGSSVKVSCKASGGTFNNHTFNWVRQAPGQGLEWMGRTIPILGSRDYAKTFQDRVTIIADKSTSTVYLELRTGVYYCATSMYYFDSGGYYRNTDLDKWGQGSLVTVSSASTKG

SEQ ID NO: 8283 - protein, 133 aa, Artificial Sequence
  Description of Artificial Sequence: Synthetic polypeptide
GLDLEHDGHHKEEPRASVTVSCEASGYNFVNYIIHWVRLTPGRGFEWMGMIDPRRGRPWSAQKFQGRLTLTRDIDSERLYMQLSGLRGDDTAVYFCARQEPDFHDGHGHTLRGMFDSWGQGSPVSVSSASTKG

SEQ ID NO: 8284 - protein, 129 aa, Artificial Sequence
  Description of Artificial Sequence: Synthetic polypeptide
QVRLVQSGPQVKTAGASMRVSCEASGYRFLDYIIVWIRQTHGQHFEYVGMINPRGGTPWPSSKFRDRLTLTRDIYTDTFYLGLNNLGSGDTAIYFCARLEADGDDYSPKMFDYWGQGTRIIVSAASTKG

SEQ ID NO: 8285 - protein, 133 aa, Artificial Sequence
  Description of Artificial Sequence: Synthetic polypeptide
QVHTFQSGSSMKKSGASVTISCEATGYNIKNYILHWVRQKPGRGFEWVGMIDPINGRPWFGQPFRGRLTLTRDLSTETFYMSLSGLTSDDTATYFCARREADYHDGNGHTLPGMFDFWGPGTLITVSSASTKG

SEQ ID NO: 8286 - protein, 129 aa, Artificial Sequence
  Description of Artificial Sequence: Synthetic polypeptide
QVSLVQSGPQVKTPGASMRVSCETSGYRFLDYIIVWIRQTHGQHFEYVGMINPRGGTPWPSSKFRDRLTMTRDIHTDTFYLGLNNLRSDDTAIYFCARLEADGDDYSPKMFDYWGQGTRIIVSAASTKG

SEQ ID NO: 8287 - protein, 129 aa, Artificial Sequence
  Description of Artificial Sequence: Synthetic polypeptide
QVRLVQSGPQMKTPGASLRLSCEVSGYRFLDYFIVWVRQTGGQGFEYVGMINPRGGRPWSSWKFRDRLSLTRDIETDTFYLGLNNLRSDDTAIYFCARLEADGDNYSPKMVDYWGQGTKIIVSPASTKG

SEQ ID NO: 8288 - protein, 124 aa, Artificial Sequence
  Description of Artificial Sequence: Synthetic polypeptide
QVQLVQSGAELKKPGSSVKVSCKASGGTFSNYAINWVRQAPGQGFEWMGGIIPLFATPTYAQKFQGRVRITADDSTSTAYMELSSLRSDDTAVYFCARPNVVRSALDYWGQGTLVTVSSASTKG

SEQ ID NO: 8289 - protein, 129 aa, Artificial Sequence
  Description of Artificial Sequence: Synthetic polypeptide
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGFWFDEVYNWFGPWSQGTLVTVASASTKG

SEQ ID NO: 8290 - protein, 128 aa, Artificial Sequence
  Description of Artificial Sequence: Synthetic polypeptide
QVRLSQSGAAVVKTGASVTISCETEGYNFVNYIIHWVRRPPGRGFEWLGMIDPRNGHPWFAQTVRGRLSLRRDTFKETVYMTLSGLTSDDTGVYFCARNEPQYHSLPGMFDYWGHGTPVTVSSASTKG

SEQ ID NO: 8291 - protein, 133 aa, Artificial Sequence
  Description of Artificial Sequence: Synthetic polypeptide
QVRLVQSGAQLKKPGASVTVSCEASGYNFVNYIINWVRQTPGRGFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 8292 - protein, 129 aa, Artificial Sequence
  Description of Artificial Sequence: Synthetic polypeptide
QVRLVQSGPQVKTPGASMRISCEASGYRFQDYIIVWIRQTHGQGFEYVGMINPRGGTPWSSSKFRDRLSLTRDIYTDTFYLGLNNLGSDDTAIYFCARLEADGGDYSPKMFDYWGQGTRIIVSAASTKG

SEQ ID NO: 8293 - protein, 133 aa, Artificial Sequence; identical to SEQ ID NO: 8255
  Description of Artificial Sequence: Synthetic polypeptide

SEQ ID NO: 8294 - protein, 128 aa, Artificial Sequence
  Description of Artificial Sequence: Synthetic polypeptide
QVRLVQSGPQVKRPGASIRLSCETSGYRFQDYIVAWIRQTRGQRFEFVGMVNPRGGRPWPSSKFRDRVTLTRDIESETFHLGLNDLTSDDTATYFCARLEADGADYSPKMFDFWGQGTKIWSPASTKG

SEQ ID NO: 8295 - protein, 130 aa, Artificial Sequence
  Description of Artificial Sequence: Synthetic polypeptide
QVRLEQSGAAVRKPGASVTLSCQASGYNFVNYIIHWVRQRPGLDFEWVGMIDPYRGRPWSAHKFEGRLSLSRDVSTEVLYMTLSSLRSDDTATYFCARAEAESQSHSRPIMFDYWGQGSRVTVSSASTKG

SEQ ID NO: 8296 - protein, 146 aa, Artificial Sequence
  Description of Artificial Sequence: Synthetic polypeptide
QVQLQESGPGLVKPSGTLSLTCAVSGASISSRNWWTWVRQPPGKGLEWIGEIYESGATNYNPSLKSRVTISVDKSKNQFSLRLTSVTAADTAVYFCARLMTFGGLIGTLDYWGQGTLVTVLQPPPRAHRYHPRNLLQEHLCARVMP

SEQ ID NO: 8297 - protein, 141 aa, Artificial Sequence
  Description of Artificial Sequence: Synthetic polypeptide
QVQLVQSGAEVKKPGSSVKVSCKASGGTFSTYAISWVRQAPGQGLEWMGGIIPSFSMSNYAQDFQGRLTITADESTSSVYMELNSLRSEDTAVYYCARDFPRFHRLVGNYDFWRGTLDRFSYMDLWGRGTAVTVSSASTKG

SEQ ID NO: 8298 - protein, 132 aa, Artificial Sequence
  Description of Artificial Sequence: Synthetic polypeptide
QVHLVQSGAEAKRPGSSVRVSCRASGGDFSSYTLSWVRQAPGQGIEWMGGVVPMLDTVHYAQKFQGRLTLSVDEGTSTAYMELSSLRSEDTAMYYCTRGRQTFRAIWSGPPAVFDIWGQGTLVIVSSASTKG

SEQ ID NO: 8299 - protein, 130 aa, Artificial Sequence; identical to SEQ ID NO: 8264
  Description of Artificial Sequence: Synthetic polypeptide

SEQ ID NO: 8300 - protein, 141 aa, Artificial Sequence
  Description of Artificial Sequence: Synthetic polypeptide
NGGSLRLSCRVSGFGFHLYEMNWVRQAPGKGLEWISSISGSGESTHYSDSITGRFSMSRDEAKDSLYLQMNNLRVEDTAVYYCTRGFSMGDGTGFSFDTWGRGTMVTVSSGLDTVSLASTKGPSVFPLAPCSRSTSDARLS

SEQ ID NO: 8301 - protein, 149 aa, Artificial Sequence
  Description of Artificial Sequence: Synthetic polypeptide
AARLDQWGTGLVKPSETLSLKCAVFGVDFPDYTWTWARQAPGKGLEWIGHRDHRGGSSYNPSLSGRATISLDTSKAQFSLHIKSVTVADTATYYCAGAVAGLWFEDAYNWFGPWSQGTLVTVAAASTKGPSVFPLAPSSKSTSGHASVL

SEQ ID NO: 8302 - protein, 128 aa, Artificial Sequence
  Description of Artificial Sequence: Synthetic polypeptide
QVRLSQSGAAVMKTGASVTISCETEGFNFVNYIIHWVRRPPGRGFEWLGMIDPRNGHPWFAQTVRGRLSLRRDTFNEIVYMTLSGLTTDDTGLYFCARNEPQYHSLPGMFDYWGQGTPVTVSSASTKG

SEQ ID NO: 8303 - protein, 149 aa, Artificial Sequence
  Description of Artificial Sequence: Synthetic polypeptide
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGLWFDETYTWFGPWSQGTRVTVASASTKGPSVFPLAPSSKSTSGTRDLS

SEQ ID NO: 8304 - protein, 133 aa, Artificial Sequence
  Description of Artificial Sequence: Synthetic polypeptide
QVRLSQSGAAMKKPGASVTISCETEGYTFINYIIHWVRQPPGRGFEWLGMIDPRNGRPWFGQSVQGRLSLRRDTYTEVVYMTLSGLTSDDAGLYFCARNEPQYHDGNGHSLPGMFDYWGQGTLVAVSSASTKG

SEQ ID NO: 8305 - protein, 133 aa, Artificial Sequence
  Description of Artificial Sequence: Synthetic polypeptide
QVRLSQSGAAVVKTGASVTISCETEGYTFVNYIIHWVRQSPGRGFEWLGMIDPRNGHPWFGQRLRGRLSLRRDRSTETVFMTLSGLTSDDTAIYFCARNEPQYYDGSGHSLPGMFDYWGQGTRVVVSSASTKG

SEQ ID NO: 8306 - protein, 133 aa, Artificial Sequence; identical to SEQ ID NO: 8255
  Description of Artificial Sequence: Synthetic polypeptide

SEQ ID NO: 8307 - protein, 129 aa, Artificial Sequence
  Description of Artificial Sequence: Synthetic polypeptide
QVQLVQSEAEVKKPGSSVKVSCKASGGTFRGYTISWVRQAPGQGLEWMGRIIPILGKAIYAPSFQGRVTLTADKSTGTAYMELSRLRSDDTAVYYCAKVKMRGSSGYYYLFDDWGQGTLVTVSSASTKG

SEQ ID NO: 8308 - protein, 129 aa, Artificial Sequence
  Description of Artificial Sequence: Synthetic polypeptide
QVRLVQSGPQVKTPGASIRLSCEASGYRFLDYFIVWVRQTPGQGFEYVGMINPRGGRPWSSWKFRDRLSLTREIDTDTFYLGLSNLRSDDTAIYFCARLEADGDDYSPKMVDYWGQGTKIIVSAASTKG

SEQ ID NO: 8309 - protein, 133 aa, Artificial Sequence; identical to SEQ ID NO: 8255
  Description of Artificial Sequence: Synthetic polypeptide

SEQ ID NO: 8310 - protein, 117 aa, Artificial Sequence
  Description of Artificial Sequence: Synthetic polypeptide
QVRLEQSGAAVRTPGASVTLSCQASGYKFVNYIIHWVRQRPGLAFEWVGMIDPYRGRPWSAHSFEGRLSLSRDVSMEILYMTLTSLRSDDTATYFCARAEAESQSHSRPIISTSGAR

SEQ ID NO: 8311 - protein, 133 aa, Artificial Sequence
  Description of Artificial Sequence: Synthetic polypeptide
QVQFFQSGSSMKKSGASVTISCEATGYNIKNHILHWVRQKPGRGFEWVGMIDPINGRPWFGQAFRGRLTLTRDLSTETFYMSLSGLTSDDTATYFCARREADYHDGNGHTLPGMFDFWGPGTLVTVSSASTKG

SEQ ID NO: 8312 - protein, 132 aa, Artificial Sequence
  Description of Artificial Sequence: Synthetic polypeptide
QVRLSQSGAAVVKTGASVTISCETEGYTFVNHIIHWVRQPPGRGFEWLGMIDPRNGHPWFGQRLRGRLSLRRDRSTETVFMTLSGLTSDDIGIYFCARNEPQYFDGSGHSLPGMFDYWGQGTRVWSSASTKG

SEQ ID NO: 8313 - protein, 122 aa, Artificial Sequence
  Description of Artificial Sequence: Synthetic polypeptide
QVHLVQSGAEVKKPGASVKVSCKVSGYTLSELSIHWVRQGPGRGLEWMANFDPEDGETIYAPQFQGRVTLTEDTSTDTAYMQLTSLRSEDTAVYYCATDRYTDTGRWGPGTLVTVSSASTKG

SEQ ID NO: 8314 - protein, 133 aa, Artificial Sequence
  Description of Artificial Sequence: Synthetic polypeptide
QVRLSQSGAAVVKTGASVTISCETEGYTFVNYIIHWVRQPPGRGFEWLGMIDPRNGHPWFGQRLQGRLSLRRDRSTETVFMTLSGLTSDDTGIYFCARNEPQYYDGSGHSLPGMFDYWGQGTRVVVSSASTKG

SEQ ID NO: 8315 - protein, 129 aa, Artificial Sequence
  Description of Artificial Sequence: Synthetic polypeptide
QARLDQWGTGLLKPSETLSLKCAVFGVLFTDYNWTWVRQSPGKGLEWIGHLDHRGGGSYNPSLESRVSISLDYSKAQFSLHLKSVTVADTALYYCAGAVKGFWFDEPSTWFGPWSQGTMVTVASASTKG

SEQ ID NO: 8316 - protein, 149 aa, Artificial Sequence
  Description of Artificial Sequence: Synthetic polypeptide
QARLDQWGTGLLKPSETLSLKCAVFGVLFTDYNWTWVRQSPGKGLEWIGHLDHRGGGNYNPSLESRVTISLDYSKAQFSLHLKSVTVADTALYYCAGAVKGFWFDEVYNWFGPGVREPWLPSPQPPPRAHRSSPWHPPPRAPLVTATVP

SEQ ID NO: 8317 - protein, 129 aa, Artificial Sequence
  Description of Artificial Sequence: Synthetic polypeptide
QVRLVQSGPQVKTPGASMRVSCEASGYRFLDYIIVWIRQTHGQHFEYVGMINPRGGTPWPSSKFRDRLSLTRDIHTDTFYLGLNNLGSDDTAIYFCARLEADGDDYSPKMFDHWGQGTRIIVSAASTKG

SEQ ID NO: 8318 - protein, 129 aa, Artificial Sequence
  Description of Artificial Sequence: Synthetic polypeptide
QARLDQWGTGLLKPSETLSLKCAVFGVLFTDYNWTWVRQSPGKELEWIGHLDHRGGGNYNPSLESRVTISLDYSKAQFSLHLKSVTVADTARYYCAGAVKGFWFDDPYTWFGPWSQGTLVTVASASTKG

SEQ ID NO: 8319 - protein, 132 aa, Artificial Sequence
  Description of Artificial Sequence: Synthetic polypeptide
QVHLVQSGAEAKRPGSSVRVSCRASGGDFSSYTLSWVRQAPGQGLERMGGVVPMLDTVHYAQKFQGRLTLSVDEGTSTAYMELSSLRSEDTAMYYCTRGRQTFRAIWSGPPVVFDIWGQGTLVSVSSASTKG

SEQ ID NO: 8320 - protein, 130 aa, Artificial Sequence
  Description of Artificial Sequence: Synthetic polypeptide
QVRLEQSGAAVKKPGASVTISCQASGYNFVKFFIHWVRQRPGQGFEWVGMIEPYRGRPWSAGNFQGRLSLSRDVSTETLYMTLNNLRSDDTAVYFCARLEAESDSHSRPIMFDHWGHGSLVTVSSASTKG

SEQ ID NO: 8321 - protein, 133 aa, Artificial Sequence
  Description of Artificial Sequence: Synthetic polypeptide
QVRLSQSGAAVMKTGASVTISCETEGYNFVNYIIHWVRRPPGRGFEWLGMIDPKNGHPWFAQAVRGRLSLRRDTFNEVVYMTLSGLTSDDTGLYFCARNEPQYHDGNGHSLPGMFDFWGQGTLVTVSSASTKG

SEQ ID NO: 8322 - protein, 125 aa, Artificial Sequence
  Description of Artificial Sequence: Synthetic polypeptide
QFRLVQSGPEVKNPGSSVTVSCKASGGTFSGLGINWVRQAPGQGLEWLGDIKTMYGTTNYAPKFQGRVTITADESTSTSYMELSGLRSEDTAVFYCVRELFGHHPAFGVWGQGTSVIVSSASTKG

SEQ ID NO: 8323 - protein, 133 aa, Artificial Sequence
  Description of Artificial Sequence: Synthetic polypeptide
QVRLSQSGAAVVKTGASVTISCETEGYTFVNYIIHWVRQPPGRGFEWLGMIDPRNGHPWFGQRFRGRLSLRRDRSTETVFMTLSGLTSDDNGIYFCARNEPQYYDGSGHSLPGMFDYWGQGTRVVVSSASTKG

SEQ ID NO: 8324 - protein, 130 aa, Artificial Sequence; identical to SEQ ID NO: 8256
  Description of Artificial Sequence: Synthetic polypeptide

SEQ ID NO: 8325 - protein, 124 aa, Artificial Sequence
  Description of Artificial Sequence: Synthetic polypeptide
QVQLVQSGAEVKKPGASVKVSCKASGYTFTNYGVSWVRQAPGQGLEWMGWISPYSGNTNYAQRLQDRVTMTTDTSTNTAYMELRSLRSDDTAVYYCAARSYYYYSMDVWGQGTTVTVSSASTKG

SEQ ID NO: 8326 - protein, 133 aa, Artificial Sequence
  Description of Artificial Sequence: Synthetic polypeptide
QVQLVQSGADVKKPGASVKVSCKVSGYTVSELSIHWVRQAPGKGLEWMGGFDPEDGKTVSAQNFQGRVTMTEDKSTGTANMELRSLRSEDTAVYYCATTVQLIVDFCNGGPCYNFDDWGQGTLVTVSSASTKG

SEQ ID NO: 8327 - protein, 130 aa, Artificial Sequence
  Description of Artificial Sequence: Synthetic polypeptide
QVRLEQSGAAVRKPGASVTLSCQASGYNFVNYIIHWVRQRPGLDFEWVGMIDPYRGRPWSAHKFQGRLSLSRDVSTEILYMTLNSLRSDDTATYFCARAEAESQSHSRPIMFDSWGQGSRVTVSSASTKG

SEQ ID NO: 8328 - protein, 133 aa, Artificial Sequence; identical to SEQ ID NO: 8255
  Description of Artificial Sequence: Synthetic polypeptide

SEQ ID NO: 8329 - protein, 128 aa, Artificial Sequence
  Description of Artificial Sequence: Synthetic polypeptide
QVQLVQSGAEVKKPGSSVKVSCKASGGTLSSYTISWVRQAPGQGLEWMGRLIPLVDITTYAQKFQGRVTITADTSTNTAYMELSNLRSEDTAIYHCATSTMIAAVINDAFDLWGQGTTVTVSSASTKG

SEQ ID NO: 8330 - protein, 130 aa, Artificial Sequence
  Description of Artificial Sequence: Synthetic polypeptide
QVRLEQSGGALRKPGASVTLSCQASGYNFVKYIIHWVRQRPGLGFEWVGMIDPYRGRPWYAHSFAGRLSLSRDTSTETLYMTLSSLKSDDTATYFCARAEAASDSHSRPIMDWTWRILCLLAVVPASTKG

SEQ ID NO: 8331 - protein, 133 aa, Artificial Sequence; identical to SEQ ID NO: 8255
  Description of Artificial Sequence: Synthetic polypeptide

SEQ ID NO: 8332 - protein, 125 aa, Artificial Sequence
  Description of Artificial Sequence: Synthetic polypeptide
QVQLVQSGAEVKKPGASVKVSCKASGNTFTSYGITWVRQAPGQGLEWMGWISAYNGNTNYAQKLQDRLTMTTDTSTSTAYMELRSLRSDDTAVYYCAFSRHYGSGNYDYWGQGTLVTVSSASTKG

SEQ ID NO: 8333 - protein, 125 aa, Artificial Sequence
  Description of Artificial Sequence: Synthetic polypeptide
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLPIGSGWYGRDYWGQGTLVTVSSASTKG

SEQ ID NO: 8334 - protein, 130 aa, Artificial Sequence; identical to SEQ ID NO: 8269
  Description of Artificial Sequence: Synthetic polypeptide

SEQ ID NO: 8335 - protein, 129 aa, Artificial Sequence
  Description of Artificial Sequence: Synthetic polypeptide
QVRLVQSGPQVKRPGASIRLSCESSGYRFQDYIVAWIRQTRGQGFEFVGMVNPRGGRPWPSSRFRDRVTLTRDIESETFYLGLNDLTSDDTATYFCARLEADGSDYSPKMFDFWGQGTKIVVSPASTKG

SEQ ID NO: 8336 - protein, 133 aa, Artificial Sequence
  Description of Artificial Sequence: Synthetic polypeptide
QVRLVQSGAQLKKPGASVTVSCEASGYNFVNYIINWVRQTPGRSFEWVGMIDPRRGRPWSAQKFQGRLTLTRDIDSEKLYMHLSGLRGDDTAVYYCARQDSDFHDGHGHTLRGMFDSWGQGSPVTVSSASTKG

SEQ ID NO: 8337 - protein, 231 aa, Artificial Sequence
  Description of Artificial Sequence: Synthetic polypeptide
VQLLESGPGLVKPSQSLSLTCAISGDSLSSDSTAWNWIRQSPSRGLEWLGRTYYRSTWFYDYAESVKSRININPDTSKSQFSLQLRSVTPEDTAVYYCARDFNKGAGYNWFDPWGPGTVVTVSSASTKGPSVFPLAPSSKSTSGGTAALDCLVKDYFPEPVMVSWNSGALTSGVHTLAAVLQSSGLYSLSSVVTVPSSSLGTQTYICNVNRKPSNTKVVKKDEPKSCDKTS

SEQ ID NO: 8338 - protein, 233 aa, Artificial Sequence
  Description of Artificial Sequence: Synthetic polypeptide
VQLLESGPGLVKPSQTLSLTCTVSGGSISTGDYYWSWIRQSPGKGLEWIGYISSSGNTYYNPSLTSRVVISFDTSMNQFSLKVDSVTAADTAVYYCARERRVLLWLGFPRGGLDYWGQGTLVTVSSASTKGPSVFPLAPSSKSTSGGTASLDCLVKDYFPEPVMVSWNSGALTSGVHTLAAVIQSSGLYSLSSVVTVPSSSLGTQTYICNVNRKPSNTKVDNKVEPKSCDKTS

SEQ ID NO: 8339 - protein, 237 aa, Artificial Sequence
  Description of Artificial Sequence: Synthetic polypeptide
VQLLESGAEVKRPGSSVRVSCQVSGGSFSNYAVSWVRQTPGHGLEWMGGIIPMFNAPNYAQKFHGRVTFIADESTRTVHMELRSLRSEDTAVYFCATASEATENDYYQSPTHYYAMDVWGQGTAVTVFSSASTKGPLVFPLAPSSKSAFGGTASLDSLVKDSLPEPVMVSWNSGALTTGVRTLAAVIQSAGLYSLISVVTVPSSSLGTQTYICNVNRKPSNIKVVNRDEPKSCVKNS

SEQ ID NO: 8340 - protein, 228 aa, Artificial Sequence
  Description of Artificial Sequence: Synthetic polypeptide
VQLLESGPGVVKPSETLSLTCTVSGASVNNYYWTWVRQPPGKGLEWIGNVYDSGDTNYNPSLSSRLSLSMDTSKNQFSLRLSSVTAADTATYYCARYHRHFIRGPLSFDYWGRGTLVTVSSASTKGPSVFPLAPSYKSTSGGTSSLDSLVKDSFPEPVMVSWNSGALTRGVHTFPAVIQSAGLYSLISVVTVPSSSMGTQTYICNVNRKPSNTKVVNKDEPKSCDKTS

SEQ ID NO: 8341 - protein, 220 aa, Artificial Sequence
  Description of Artificial Sequence: Synthetic polypeptide
DIQLTQSPSSLSASVGDRVTITCRASQSIGSYLNWYQQKPGKAPKLLIYAASTLQSGVPSRFSGSGSGTDFTLTISSLQPEDSATYYCQQSYSTPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECHVGSGT

SEQ ID NO: 8342 - protein, 234 aa, Artificial Sequence
  Description of Artificial Sequence: Synthetic polypeptide
QVQLVQSGAEVKKPGESLKISCKVSGYNFASEWIGWVRQMPGKGLEWMGIIYPGDSDTKYSPSFQGQVIISADKSINTAYLQWSSLKASDTAIYYCARQNHYGSGSYFYRTAYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 8343 - protein, 236 aa, Artificial Sequence
  Description of Artificial Sequence: Synthetic polypeptide
QVQLVQSGAEVKKPGSSVKVSCEASGVTSSSYTISWVRLAPGQGLEWMGRITPIFDITNYAQKFQGRVTLTADKSTGTTYMELSSLRSDDTAVYYCARDKSDVVVVTSIRPAYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 8344 - protein, 451 aa, Artificial Sequence
  Description of Artificial Sequence: Synthetic polypeptide
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 8345 - protein, 246 aa, Artificial Sequence
  Description of Artificial Sequence: Synthetic polypeptide
  MOD_RES (1)..(1): Any amino acid
  MOD_RES (112)..(112): Any amino acid
XEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYXDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCGLEVLF

SEQ ID NO: 8346 - protein, 248 aa, Artificial Sequence
  Description of Artificial Sequence: Synthetic polypeptide
  MOD_RES (1)..(1): Any amino acid
  MOD_RES (110)..(111): Any amino acid
XRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYYXXDFYDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKGLEVLFQ

SEQ ID NO: 8347 - protein, 244 aa, Artificial Sequence
  Description of Artificial Sequence: Synthetic polypeptide
QVQLQESGPGLVKPSETLSLTCTVSGGSISSYYWSWIRQPPGKGLEWIGYIYYSGSTNYNPSLKSRVTISVDTSKNQFSLKLSSVTAADTAVYYCARTQQGKRIYGVVSFGDYYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHHHHHH

SEQ ID NO: 8348 - protein, 235 aa, Artificial Sequence
  Description of Artificial Sequence: Synthetic polypeptide
QVHLQESGPGLVKPSETLSLTCNVSGTLVRDNYWSWIRQPLGKQPEWIGYVHDSGDTNYNPSLKSRVHLSLDKSKNLVSLRLTGVTAADSAIYYCATTKHGRRIYGVVAFKEWFTYFYMDVWGKGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 8349 - protein, 235 aa, Artificial Sequence
  Description of Artificial Sequence: Synthetic polypeptide
QLHLQESGPGLVKPPETLSLTCSVSGASINDAYWSWIRQSPGKRPEWVGYVHHSGDTNYNPSLKRRVTFSLDTAKNEVSLKLVDLTAADSATYFCARALHGKRIYGIVALGELFTYFYMDVWGKGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 8350 - protein, 236 aa, Artificial Sequence
  Description of Artificial Sequence: Synthetic polypeptide
QVQLQESGPGLVRPSETLSVTCIVSGGSISNYYWTWIRQSPGKGLEWIGYISDRETTTYNPSLNSRAVISRDTSKNQLSLQLRSVTTADTAIYFCATARRGQRIYGVVSFGEFFYYYYMDVWGKGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 8351 - protein, 233 aa, Artificial Sequence
  Description of Artificial Sequence: Synthetic polypeptide
QVQLQESGPGLVKPAETLSLTCSVSGESINTGHYYWGWVRQVPGKGLEWIGHIHYTTAVLHNPSLKSRLTIKIYTLRNQITLRLSNVTAADTAVYHCVRSGGDILYYYEWQKPHWFSPWGPGIHVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCD

SEQ ID NO: 8352 - protein, 234 aa, Artificial Sequence
  Description of Artificial Sequence: Synthetic polypeptide
QLQMQESGPGLVKPSETLSLSCTVSGDSIRGGEWGDKDYHWGWVRHSAGKGLEWIGSIHWRGTTHYKESLRRRVSMSIDTSRNWFSLRLASVTAADTAVYFCARHRHHDVFMLVPIAGWFDVWGPGVQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 8353 - protein, 225 aa, Artificial Sequence
  Description of Artificial Sequence: Synthetic polypeptide
LESGGGVVQPGRSLRLSCAASGFSFSSHGMHWVRQAPGKGLEWVAFIWFDGSNERYADSVKGRFTITRDNPKNTLYLQMNSLRVEDTAVYYCVRRGGSILTGFHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTS

SEQ ID NO: 8354 - protein, 225 aa, Artificial Sequence
  Description of Artificial Sequence: Synthetic polypeptide
LESGGGVVQPGRSLRLSCSASGFSFRDYAMHWVRQAPGKGLEWVAFIWFDGSNERYADSVKGRFTITRDNPKNTLYLQMNSLRVEDTAVYYCVRRGGSILTGFHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTS

SEQ ID NO: 8355 - protein, 225 aa, Artificial Sequence
  Description of Artificial Sequence: Synthetic polypeptide
LESGGGLVKPGGSLRLSCAASGFTFSSYAMHWVRQAPGKGLEWVAFIWFDGSNERYADSVKGRFTITRDNPKNTLYLQMNSLRVEDTAVYYCVRRGGSILTGFHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTS

SEQ ID NO: 8356 - protein, 228 aa, Artificial Sequence [sequence omitted]

SEQ ID NO: 8357 - protein, 121 aa, Artificial Sequence
  Description of Artificial Sequence: Synthetic polypeptide
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 8358 - protein, 10 aa, Artificial Sequence
  Description of Artificial Sequence: Synthetic peptide
QVQSMRTLNG

SEQ ID NO: 8359 - protein, 121 aa, Artificial Sequence
  Description of Artificial Sequence: Synthetic polypeptide
QVQLVQSGGQMKKPGESMRISCQASGYEFIDCTLNWVRLAPGRRPEWMGWLKPRGGAVNYARPLQGRVTMTRDVYSDTAFLELRSLTADDTAVYYCTRGKNCDYNWDFEHWGRGTPVTVSS

SEQ ID NO: 8360 - protein, 130 aa, Artificial Sequence
  Description of Artificial Sequence: Synthetic polypeptide
QVQLVQSGAVIKTPGSSVKISCRASGYNFRDYSIHWVRLIPDKGFEWIGWIKPLWGAVSYARQLQGRVSMTRQLSQDPDDPDWGVAYMEFSGLTPADTAEYFCVRRGSCDYCGDFPWQYWGQGTVVVVSS

SEQ ID NO: 8361 - protein, 130 aa, Artificial Sequence; identical to SEQ ID NO: 8360
  Description of Artificial Sequence: Synthetic polypeptide

SEQ ID NO: 8362 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRHGAVNYARQLQGRVTMTRDMYSETAFLELRSLTSDDTAVYFCTRGKYCTARDYYNWDFEHWGQGTPVTVSS

SEQ ID NO: 8363 - protein, 125 aa, Artificial Sequence
  Description of Artificial Sequence: Synthetic polypeptide
QVRLSQSGGQMKKPGDSMRISCRASGYEFINCPINWVRLAPGKRPEWMGWMKPRHGAVNYARQLQGRVTMTRDMYSETAFLELRSLTSDDTAVYFCARGKYCTARDYYNWDFEHWGQGTPVTVSS

SEQ ID NO: 8364 - protein, 125 aa, Artificial Sequence
  Description of Artificial Sequence: Synthetic polypeptide
QVRLSQSGGQMKKPGDSMRISCRASGYEFINCPINWVRLAPGKRPEWMGWMKPRHGAVSYARQLQGRVTMTRDMYSETAFLELRSLTSDDTAVYFCARGKYCTARDYYNWDFEHWGQGTPVTVSS

SEQ ID NO: 8365 - protein, 235 aa, Artificial Sequence
  Description of Artificial Sequence: Synthetic polypeptide
QHSQVQSGTQIKTPGASVTLSCGTSGYDFMESLINWVRQEIGKRPEWLGWMNPRGGGVNYAQRFQGKVTMTRDVSSGTAYLTLRGLTSDDTAKYYCVRGKSCCNGRRYCNGADCFNWDFEYWGQGTLVIVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8366 - protein, 224 aa, Artificial Sequence
  Description of Artificial Sequence: Synthetic polypeptide
  MOD_RES (1)..(1): Any amino acid
XVQFVQSGAEVKKPGASVRVSCEASGYSFTDYVLQWIRQAPGQRPEWMGWIKPERGAVSYAPQFQGRLTLTRDLYTETAYMHFKNLRSDDTAIYYCARGVRRDASWWLQFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8367 - protein, 131 aa, Artificial Sequence
  Description of Artificial Sequence: Synthetic polypeptide
QVQLVQSGAAVRKPGASVTVSCKFAEDDDYSPHWVNPAPEHYIHFLRQAPGQQLEWLAWMNPTNGAVNYAWQLHGRLTATRDGSMTTAFLEVRSLRSDDTAVYYCARAQKRGRSEWAYAHWGQGTPVLVSS

SEQ ID NO: 8368 - protein, 236 aa, Artificial Sequence
  Description of Artificial Sequence: Synthetic polypeptide
QVQLVQSGAAVRKPGASVTVSCKFAEDDDYSPYWVNPAPEHFIHFLRQAPGQQLEWLAWMNPTNGAVNYAWYLNGRVTATRDRSMTTAFLEVKSLRSDDTAVYYCARAQKRGRSEWAYAHWGQGTPVVVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 8369 - protein, 131 aa, Artificial Sequence
  Description of Artificial Sequence: Synthetic polypeptide
QVQLVQSGAAVRKPGASVTVSCKFAEDDDFSPHWVNPAPEHYIHFLRQAPGQQLEWLAWMKPTNGAVNYAWQLQGRVTVTRDRSQTTAFLEVKNLRSDDTAVYYCARAQKRGRSEWAYAHWGQGTPVVISA

SEQ ID NO: 8370 - protein, 131 aa, Artificial Sequence
  Description of Artificial Sequence: Synthetic polypeptide
QVQLVQSGAAVRKPGASISVSCKFADADDYSPHWMNPAPEHYIHFLRQAPGQQLEWLAWMNPTNGAVNYAWYLNGRVTATRDRSMTTAFLEVRSLRSDDTAVYYCARAQKRARSEWAYAHWGQGTPVVVSS

SEQ ID NO: 8371 - protein, 131 aa, Artificial Sequence
  Description of Artificial Sequence: Synthetic polypeptide
QVQLVQSGAAVRKPGASVTVSCKFAEDDDWSPHWVNPAPEHYIHFLRQAPGQQLEWLAWMNPTNGAVNYAWQLNGRLTATRDTSMTTAFLEVKSLRSDDTAVYYCARAQKRGRSEWAYAHWGQGTPVVVSS

SEQ ID NO: 8372 - protein, 125 aa, Artificial Sequence
  Description of Artificial Sequence: Synthetic polypeptide
QVRLSQSGGQMKKPGDSMRISCRASGYEFINCPINWIRLAPGKRPEWMGWMKPRHGAVSYARQLQGRVTMTRDMYSETAFLELRSLTSDDTAVYFCTRGKYCTARDYYNWDFEHWGQGTPVTVSS

SEQ ID NO: 8373 - protein, 125 aa, Artificial Sequence
  Description of Artificial Sequence: Synthetic polypeptide
QVQLVQSGSGVKKPGASVRVSCWTSEDIFERTELIHWVRQAPGQGLEWIGWVKTVTGAVNFGSPDFRQRVSLTRDRDLFTAHMDIRGLTQGDTATYFCARQKFYTGGQGWYFDLWGRGTLIVVSS

SEQ ID NO: 8374 - protein, 125 aa, Artificial Sequence
  Description of Artificial Sequence: Synthetic polypeptide
QVQLVQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 8375 - protein, 227 aa, Artificial Sequence
  Description of Artificial Sequence: Synthetic polypeptide
  MOD_RES (1)..(1): Any amino acid
XVHLMQSGTEMKKPGASVRVTCQTSGYTFSDYFIHWLRQVPGRGFEWMGWMNPQWGQVNYARTFQGRVTMTRDVYREVAYLDLRSLTFADTAVYFCARRMRSQDREWDFQHWGQGTRIIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 8376 - protein, 261 aa, Artificial Sequence
  Description of Artificial Sequence: Synthetic polypeptide
MKYLLPTAAAGLLLLAAQPAMAEVQLLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTS

SEQ ID NO: 8377 - protein, 261 aa, Artificial Sequence; identical to SEQ ID NO: 8376
  Description of Artificial Sequence: Synthetic polypeptide

SEQ ID NO: 8378 - protein, 261 aa, Artificial Sequence
  Description of Artificial Sequence: Synthetic polypeptide
MKYLLPTAAAGLLLLAAQPAMAEVQLLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSPGTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTS

SEQ ID NO: 8379 - protein, 230 aa, Artificial Sequence
  Description of Artificial Sequence: Synthetic polypeptide
EVQLLESGPGLLKPSETLSLTCTVSGGSMINYYWSWIRQPPGERPQWLGHIIYGGTTKYNPSLESRITISRDISKNQFSLRLNSVTAADTAIYYCARVAIGVSGFLNYYYYMDVWGSGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 8380 - protein, 227 aa, Artificial Sequence
  Description of Artificial Sequence: Synthetic polypeptide
SQRLVQSGPQVRKPGSSVRISCETSGYTFNAYILHWFRQAPGRSFEWMGWIKPKFGAVNYAHSFQGRITLTRDIYRETAFLDLTGLRFDDTAVYYCARDRLYDGSSWRLDPWGQGTRVVVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 8381 - protein, 230 aa, Artificial Sequence
  Description of Artificial Sequence: Synthetic polypeptide
QVQLVQSGAEVKKPGASVKVSCQASGYRFSNFVIHWVRQAPGQRFEWMGWINPYNGNKEFSAKFQDRVTFTADTSANTAYMELRSLRSADTAVYYCARVGPYSWDDSPQDNYYMDVWGKGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 8382 - protein, 126 aa, Artificial Sequence
  Description of Artificial Sequence: Synthetic polypeptide
LLESGPGLVKPSETLSLTCTVSGGSLSSFDWNWIRQPAGKGLEWIGRIYPSGNTHYNPSLRSRVTMSRDTSKNQFSVKLTSVTAADTALYYCARENTGRTIEEIGNFFDIWGQGTLVTVSSASTKG

SEQ ID NO: 8383 - protein, 122 aa, Artificial Sequence
  Description of Artificial Sequence: Synthetic polypeptide
LLKSGGGLVKPGGSLRLSCVISAFSFSGYNINWVRQAPGKGLEWVSSISMSTGSLSYADSMKGRFTISRDNAKNSVYLEMSSLTAEDTAMYYCAARTPLVGRALDIWGQGTVVTVSSASTKG

SEQ ID NO: 8384 - protein, 128 aa, Artificial Sequence
  Description of Artificial Sequence: Synthetic polypeptide
LLESGGGLVKPGGSLRLSCSASGFTFSSYGMNWVRQAPGKGPEWVAYISSSRKYTEYADSVKGRFTISRENAKYSVFLQLDSLTAEDTAIYYCARGRDFYSGFGRRDDFHLHYMDVWGKGTTVTVSSA

SEQ ID NO: 8385 - protein, 126 aa, Artificial Sequence
  Description of Artificial Sequence: Synthetic polypeptide
LLEQSGGGLVQPGGSLRISCVASGDIFYSYAMSWVRQAPGKGLEWVASISGTGGSNYYADSVKGRFTISRDNSKSTLYLQMNSLRAEDTALYYCARDRGPRIGIRGWFDSWGQGTLVTVSSASTKG

SEQ ID NO: 8386 - protein, 124 aa, Artificial Sequence
  Description of Artificial Sequence: Synthetic polypeptide
LLESGGGLVQPGGSLRLSCAASGFLYSSFAMSWVRQAPGKGLAWVSTISASGGSTKYADSVKGRFIISRDNSKNTIYLQMDSLRAEDTAVYYCAKNFRAFARDPWGDWGQGTLVTVSSASASTK

SEQ ID NO: 8387 - protein, 124 aa, Artificial Sequence
  Description of Artificial Sequence: Synthetic polypeptide
LEQSGAEVKKPGASVKVSCQASGYRFSNFVIHWVRQAPGQRFEWMGWINPYNGNKEFSAKFQDRVTFTADTSANTAYMELRSLRSADTAVYYCARVGPYSWDDSPQDNYYMDVWGKGTTVIVSS

SEQ ID NO: 8388 - protein, 124 aa, Artificial Sequence
  Description of Artificial Sequence: Synthetic polypeptide
LEQSGAEVKKPGASVKVSCQASGYRFSNFVIHWVRQAPGQRFEWMGWINPYNGNKEFSAKFQDRVTFTADTDANTAYMELRSLRSADTAIYYCARVGPYTWDDSPQDNYYMDVWGKGTKVIVSS

SEQ ID NO: 8389 - protein, 124 aa, Artificial Sequence
  Description of Artificial Sequence: Synthetic polypeptide
LEQSGAEVKKPGASVKVSCQASGYRFSNFVIHWVRQAPGQRFEWMGWINPYNGNKEFSAKFQDRVTFTADTDANTAYMELRSLRSTDTAIYYCARVGPYTWDDSPQDNYYMDVWGKGTKVIVSS

SEQ ID NO: 8390 - protein, 112 aa, Artificial Sequence
  Description of Artificial Sequence: Synthetic polypeptide
LEESGGGLVKAGGSLRLSCVGSGFTFSSAWMAWVGQAPGRGLEWVGLIKSKADGETTDYATPVKGRFSISRNNLEDTVYLQMDSLRADDTAVYYCATQKPRYFDLLSGQYRR

SEQ ID NO: 8391 - protein, 125 aa, Artificial Sequence [sequence omitted]

SEQ ID NO: 8392 - protein, 125 aa, Artificial Sequence [sequence omitted]

SEQ ID NO: 8393 - protein, 125 aa, Artificial Sequence
  Description of Artificial Sequence: Synthetic polypeptide
LEQSGEAVVQPGRSLRLSCAASGFIFRNYAMHWVRQAPGKGLEWVALIKYDGRNKYYADSVKGRFTISRDNSKNTLYLQMNSLRAEDTAVYYCARDIGLKGEHYDILTAYGPDYWGQGTLVTVSS

SEQ ID NO: 8394 - protein, 125 aa, Artificial Sequence
  Description of Artificial Sequence: Synthetic polypeptide
LEESGEAVVQPGTSLRLSCAASGFTFRNYAMHWVRQAPGKGLEWVALIKYDGRNKYYADSVKGRFSISRDNSKNTLYLEMNSLRAEDTAVYYCARDIGLKGEHYDILTAYGPDYWGQGALVTVSS

SEQ ID NO: 8395 - protein, 128 aa, Artificial Sequence
  Description of Artificial Sequence: Synthetic polypeptide
LEQSGGGVVKPGGSLRLSCEGSGFTFPNAWMTWVRQSPGKGLEWVASIKSKFDGGSPHYAAPVEGRFTISRNDLEDKVFLQMNGLKAEDTGVYYCATRYPRYSEMMGGVRKHFYMDVWGKGTTVSVSS

SEQ ID NO: 8396 - protein, 108 aa, Artificial Sequence
  Description of Artificial Sequence: Synthetic polypeptide
SYVRPLSVALGETASISCGRQALGSRAVQWYQHRPGQAPILLIYNNQDRPSGIPERFSGTPDINFGTRATLTISGVEAGDEADYYCHMWDSRSGFSWSFGGATRLTVL

SEQ ID NO: 8397 - protein, 107 aa, Artificial Sequence
  Description of Artificial Sequence: Synthetic polypeptide
SSLPLSVAPGATAKIACGEKSFASRAVQWYQQKPGQAPVLIIYNNQDRPAGVSERFSGTPDVGFGSTATLTISRVEAGDEADYYCHKWDSRSPLSWVFGGGTQLTVL

SEQ ID NO: 8398 - protein, 108 aa, Artificial Sequence
  Description of Artificial Sequence: Synthetic polypeptide
SYVRPLSVALGETARISCGRQALGSRAVQWYQHRPGQAPILLIYNNQDRPSGIPERFSGTPDINFGTRATLTISGVEAGDEADYYCHMWDSRSGFSWSFGGATRLTVL

SEQ ID NO: 8399 - protein, 108 aa, Artificial Sequence; identical to SEQ ID NO: 8398
  Description of Artificial Sequence: Synthetic polypeptide

SEQ ID NO: 8400 - protein, 105 aa, Artificial Sequence
  Description of Artificial Sequence: Synthetic polypeptide
SFVSVAPGQTARITCGEESLGSRSVIWYQQRPGQAPSLIMYNNHDRPSGIPERFSGSPGSTFGTTATLTITSVEAGDEADYYCHIWDSRRPTNWVFGEGTTLTVL

SEQ ID NO: 8401 - protein, 105 aa, Artificial Sequence
  Description of Artificial Sequence: Synthetic polypeptide
SFVSVAPGQTARITCGEESLGSRSVIWYQQRPGQAPSLIIYNNNDRPSGIPERFSGSPGSTFGTTATLTITSVEAGDEADYYCHIWDSRRPTNWVFGEGTTLTVL

SEQ ID NO: 8402 - protein, 107 aa, Artificial Sequence
  Description of Artificial Sequence: Synthetic polypeptide
SSLPLSLAPGATAKIPCGEKSRGSRAVQWYQQKPGQAPTLIIYNNQDRPAGVSERYSGNPDVAIGVTATLTISRVEAGDEAEYYCHYWDSRSPISWVFGGWTQLTVL

SEQ ID NO: 8403 - protein, 108 aa, Artificial Sequence; identical to SEQ ID NO: 8398
  Description of Artificial Sequence: Synthetic polypeptide

SEQ ID NO: 8404 - protein, 105 aa, Artificial Sequence
  Description of Artificial Sequence: Synthetic polypeptide
SSMSVSPGETAKITCGEKSIGSRAVQWYQKKPGQPPSLIIYNNQDRPSGVPERFSASPDIEFGTTATLTITNVEAGDEADYYCHIYDARRPTNWVFDRGTTLTVL

SEQ ID NO: 8405 - protein, 105 aa, Artificial Sequence
  Description of Artificial Sequence: Synthetic polypeptide
SSMSVSPGETAKISCGKESIGSRAVQWYQQKSGQPPSLIIYNNQDRPSGVPERFSATPDFGAGTTATLTITNVEADDEADYYCHIYDARGGTNWVFDRGATLTVL

SEQ ID NO: 8406 - protein, 105 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVL

SEQ ID NO: 8407 - protein, 105 aa, Artificial Sequence; identical to SEQ ID NO: 8401
  Description of Artificial Sequence: Synthetic polypeptide

SEQ ID NO: 8408 - protein, 112 aa, Artificial Sequence
  Description of Artificial Sequence: Synthetic polypeptide
  MOD_RES (2)..(2): Any amino acid
  MOD_RES (21)..(21): Any amino acid
  MOD_RES (25)..(25): Any amino acid
  MOD_RES (67)..(68): Any amino acid
  MOD_RES (79)..(79): Any amino acid
  MOD_RES (97)..(97): Any amino acid
  MOD_RES (100)..(100): Any amino acid
SXVRPQPPSLSVAPGETARIXCGEXSLGSRAVQWYQQRPGQAPSLIIYNNQDRPSGIPERFSGSPDXXFGTTATLTITXVEAGDEADYYCHIWDSRXPTXWVFGGGTTLTVL

SEQ ID NO: 8409 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 8410 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 8411 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 8412 - protein, 326 aa, Artificial Sequence
  Description of Artificial Sequence: Synthetic polypeptide
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 8413 - protein, 238 aa, Artificial Sequence
  Description of Artificial Sequence: Synthetic polypeptide
EVQLVESGGGLIRPGGSLRLSCKGSGFIFENFGFGWVRQGPGKGLEWVSGTNWNGGDSRYGDSVKGRFTISRDNSNNFVYLQMNSLRPEDTAIYYCARGTDYTIDDQGIRYQGSGTFWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 8414 - protein, 231 aa, Artificial Sequence
  Description of Artificial Sequence: Synthetic polypeptide
QVQVVQSGAEVRKPGASVKVSCKVSGFTLTGLSIHWVRQAPGKGLEWMGGFGPEENEIIYAQKFQGRVSMTEDTSTNTAYMELSSLRSEDTAVYYCATGGNYYNLWTGYYPLAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 8415 - protein, 226 aa, Artificial Sequence
  Description of Artificial Sequence: Synthetic polypeptide
QVQLQQWGPGLLKPSETLSLTCAVYGGSFGRYYWSWIRQSSGEGLEWLGQIDHTGSTTYNPSLKGRVTISIDSSTNQFSLKVTSVIAADTAVYYCARAPSGYPGVSLYQYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 8416 - protein, 193 aa, Artificial Sequence
  Description of Artificial Sequence: Synthetic polypeptide
SVGDRVTITCRASQSISNWLAWYQQKPGRAPKLLMYKASSLKSGVPSRFSGSGSGTEFTLTISSLQSDDFATYYCQQHDSSPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVT

SEQ ID NO: 8417 - protein, 119 aa, Artificial Sequence
  Description of Artificial Sequence: Synthetic polypeptide
EVQLVESGGGLIQPGGSLRLSCAASGFTVSSSSMSWVRQAPEKGLEWVSVVYSGGNTYNADSVKGRFSISRDNSKNTVYLQMNSLRADDTAVYYCARDLGGGDRSSDYWGQGTLVTVSS

SEQ ID NO: 8418 - protein, 129 aa, Artificial Sequence
  Description of Artificial Sequence: Synthetic polypeptide
EVQLVESAAEVKKPGASVKVSCKASGYTFTSYGISWVRQAPGQGLQWMGWISAYNGNTKFAQEFKGRVTMTTDTSATTAYMELRSLRSDDTAVYYCARRNYYDSGSYYIRDGDYSMDVWGQGTLVTVSS

SEQ ID NO: 8419 - protein, 130 aa, Artificial Sequence
  Description of Artificial Sequence: Synthetic polypeptide
QGQLVQSGGELKKPGASVKISCKTSGYRFSFYHIWIRQLVGRGPEWMGWISPYNGGTNLAPELRGRLVLTTEREVVDTMTLSTGTAHMELRNLRSDDTGIYFCAKGLLRDGSSTWLPHLWGQGTLLTVSS

SEQ ID NO: 8420 - protein, 131 aa, Artificial Sequence
  Description of Artificial Sequence: Synthetic polypeptide
QGQLVQSGGELKRPGASVKISCKTSGYRFSSYHINWIRQVIGRGPEWMGWISPYSGGTNLAPEFRGRLVLTTEREVVDTMTLSTGTAHMELRNLKSDDTGIYFCAKGLLRDGSSTWLPHLWGQGTLLTVSS

SEQ ID NO: 8421 - protein, 131 aa, Artificial Sequence
  Description of Artificial Sequence: Synthetic polypeptide
QGQLVQSGGELKKPGASVKISCKTSGYRFSFYHINWIRQVVGRGPEWMGWISPYNGGTNLAPEFRGRLVLTTEREVVDTMTMSTGTAHMELRNLKSDDTGLYFCAKGLLRDGPSTWLPHLWGQGTLLTVSS

SEQ ID NO: 8422 - protein, 131 aa, Artificial Sequence
  Description of Artificial Sequence: Synthetic polypeptide
QGQLVQSGAELKKPGASVKISCKTSGYKFSFFHINWIRQTAGRGPEWLGWISPYSGDKNYAPAFQDRVIMTTDKEVPVTSFTSTGTAYLEIRSLKPDDTGIYFCARGLLRDGSSTWLPYLWGQGTLLTVSS

SEQ ID NO: 8423 - protein, 130 aa, Artificial Sequence
  Description of Artificial Sequence: Synthetic polypeptide
QGQLVQSGAELKKPGASVKISCKTSGYRFNFYHIWIRQTAGRGPEWMGWISPYSGDKNLAPAFQDRVIMTTDTEVPVTSFTSTGAAYMEIRNLKFDDTGTYFCAKGLLRDGSSTWLPYLWGQGTLLTVSS

SEQ ID NO: 8424 - protein, 126 aa, Artificial Sequence
  Description of Artificial Sequence: Synthetic polypeptide
EVQLVESGGGVVRPGGSLRLSCAASGFAFGEYGMSWVRQAPGKGLEWVSGINWNGGSTGYADSVQGRFTTSRDNAKNSLYLQMNSLRAEDTALYYCARDENYDILTGNYYYGMDVWGQGTTVTVSS

SEQ ID NO: 8425 - protein, 481 aa, Artificial Sequence
  Description of Artificial Sequence: Synthetic polypeptide
MKHLWFFLLLVAAPRWVLSQVQLQESGPGLVRPSETLSVTCIVSGGSISNYYWTWIRQSPGKGLEWIGYISDRETTTYNPSLNSRAVISRDTSKNQLSLQLRSVTTADTAIYFCATARRGQRIYGVVSFGEFFYYYYMDVWGKGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8426 - protein, 462 aa, Artificial Sequence
  Description of Artificial Sequence: Synthetic polypeptide
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8427 - protein, 472 aa, Artificial Sequence
  Description of Artificial Sequence: Synthetic polypeptide
MKHLWIFLLLVATPRWVESQLHLQESGPGLVKPPETLSLTCSVSGASINDAYWSWIRQSPGKRPEWVGYVHHSGDTNYNPSLKRRVTFSLDTAKNEVSLKLVDLTAADSATYFCARALHGKRIYGIVALGELFTYFYMDVWGKGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQ

SEQ ID NO: 8428 - protein, 482 aa, Artificial Sequence
  Description of Artificial Sequence: Synthetic polypeptide
MKHLWFFLLLVAAPRWVVSQVHLQESGPGLVTPSETLSLTCTVSNGSVSGRFWSWIRQSPGRGLEWIGYFSDTDRSEYNPSLRSRLTLSVDRSKNQLSLRLKSVTAADSATYYCARAQQGKRIYGIVSFGEFFYYYYMDAWGKGTPVTVSSASTKGPSVFPLAPSSKSTSGGTAALGCLVICDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8429 - protein, 481 aa, Artificial Sequence
  Description of Artificial Sequence: Synthetic polypeptide
MKHLWFFLLLVAAPRWVLSQMQLQESGPGLVKPSETLSLTCSVSGASISDSYWSWIRRSPGKGLEWIGYVHKSGDTNYIPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8430 - protein, 481 aa, Artificial Sequence
  Description of Artificial Sequence: Synthetic polypeptide
MKHLWFFLLLVAAPRWVVSQVHLQESGPGLVTPSETLSLTCTVSNGSVSGRFWSWIRQSPGRGLEWIGYFSDTDRSEYNPSLRSRLTLSVDRSKNQLSLKLKSVTAADSATYYCARAQQGKRIYGIVSFGELFYYYYMDAWGKGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8431 - protein, 396 aa, Artificial Sequence
  Description of Artificial Sequence: Synthetic polypeptide
CAGGTTCATCTGCAGGAGTCGGGCCCCGGACTGGTGAAGCCTTCGGAGACCCTGTCCCTCACGTGCAATGTGTCTGGGACCCTCGTGCGTGATAACTACTGGAGCTGGATCAGACAACCCCTCGGGAAGCAACCTGAGTGGATTGGCTATGTCCATGACAGCGGGGACACGAATTACAACCCCTCCCTGAAGAGTCGAGTCCACTTATCGTTGGACAAGTCCAAAAACCTGGTGTCCCTGAGGCTGACCGGCGTGACCGCCGCGGACTCGGCCATATATTATTGCGCGACAACAAAACACGGGAGGAGGATTTATGGCGTCGTTGCCTTCAAAGAGTGGTTCACCTATTTCTACATGGACGTCTGGGGCAAAGGGACTTCGGTCACCGTCTCCTCA

SEQ ID NO: 8432 - protein, 490 aa, Artificial Sequence
  Description of Artificial Sequence: Synthetic polypeptide
MDWIWRILFLVAAVASAHSQVQLVQSGPEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKSPNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8433 - protein, 491 aa, Artificial Sequence
  Description of Artificial Sequence: Synthetic polypeptide
  MOD_RES (32)..(32): Selenocysteine
MDWIWRILFLVAAVASAHSQVQLVQSGAEVIXCPGSSVKVSCKASGNTFRKYDVHWVRQATGQGLEWVGWMSHEGDKTESAQRFKGRVSFTRDNSASTAYIELRGLTSDDTAIYYCTGGSKHRLRDYVLYDDYGLINQQEWNDYLEFLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8434 - protein, 490 aa, Artificial Sequence
  Description of Artificial Sequence: Synthetic polypeptide
MDWIWRILFLVAAVASAHAQVQLEQSGAEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8435 - protein, 495 aa, Artificial Sequence
  Description of Artificial Sequence: Synthetic polypeptide
MDWIWRILFLVAAVASAHSQVQLVQSGPEVKKPGSSVKVSCKASGNTFSKYDVHWVRQATGQGLEWVGWISHERDKTESAQRFKGRVTFTRDTSATTAYMELRGLTSDDTAIYYCTRGSKHRLRDYVLYDDYGLINYQEWNDYLEFLDVWGHGTAVTVSSASTKGPSVFPLAPSSKSTSGGTAALGCLVICDYFPEPVTVSWNSGALTSGVHTFPAVLQSSGLYSLSSVVTVPSSSLGTQTYICNVNHKPSNTKVDICRVEPKSCDKTHTCPPCPAPELLGGPSVFLFPPKPKDTLMISRTPEVTCVVVDVSHEDPEVKFNWYVDGVEVHNAKTICPREEQYNSTYRVVSVLTVLHQDWLNGICEYKCKVSNICALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8436 - protein, 489 aa, Artificial Sequence
  Description of Artificial Sequence: Synthetic polypeptide
MDWIWRILFLVAAATSAHSQVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLYNEYGPNYEEWGDYLATLDVWGHGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8437 - protein, 121 aa, Artificial Sequence
  Description of Artificial Sequence: Synthetic polypeptide
EVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARGPIAAATHAFDIWGQGTMVTVSS

SEQ ID NO: 8438 - protein, 131 aa, Artificial Sequence
  Description of Artificial Sequence: Synthetic polypeptide
QGQLVQSGAELKKPGGSVKISCKTSGYRFNFYHINWIRQTAGRGPEWMGWISPYSGDKNLAPAFQDRVIMTTDKEVPVTAFTSTGTAYMEIRNLKFDDTGIYFCAKGLLRDGSSTWLPYLWGQGTLLTVSS

SEQ ID NO: 8439 - protein, 484 aa, Artificial Sequence
  Description of Artificial Sequence: Synthetic polypeptide
MKHLWFFLLLVAAPRWVLSQPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8440 - protein, 486 aa, Artificial Sequence
  Description of Artificial Sequence: Synthetic polypeptide
MKHLWFFLLLVAAPRWVLSQPQLQESGPGLVEASETLSLTCTVSGDSTAGCDYFWGWVRQPPGKGLEWIGGLSHCAGYYNTGWTYHNPSLKSRLTISLDTPKNQVFLKLNSVTAADTAIYYCARFDGEVLVYNDWPKPAWVDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVICFNWYVDGVEVHNAKTKPREEQYNSTYRVVSVLTVLHQDWLNGKEYKCKVSNKALPAPIEKTISICAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8441 - protein, 478 aa, Artificial Sequence
  Description of Artificial Sequence: Synthetic polypeptide
MKHLWFFLLLVAAPRWVLSQVQLQESGPGLVKPSETLSLTCTVSGDSINTGHHYWGWVRQVPGKGPEWIAHIHYNTAVLHNPALKSRVTISIFTLKNLITLRLSNMTAADTAVYFCVRSGGDILYYNEWQKPHWFYPWGPGILVTVSSASTKGPSVFPLAPSSKSTSGGTAALGCLVKDYFPEPVTVSWNSGVALTSGVHTFPALQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8442 - protein, 478 aa, Artificial Sequence
  Description of Artificial Sequence: Synthetic polypeptide
MKHLWFFLLLVAAPRWVLSQVQLQESGPGLVKPSETLSLTCTVSGDSINTGHHYWGWVRQVPGKGPEWIAHIHYNTAVLHNPALKSRVTISIFTLKNLITLSLSNVTAADTAVYFCVRSGGDILYYIEWQKPHWFYPWGPGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8443 - protein, 484 aa, Artificial Sequence [sequence omitted]

SEQ ID NO: 8444 - protein, 484 aa, Artificial Sequence
  Description of Artificial Sequence: Synthetic polypeptide
MKHLWFFLLLVAAPRWVLSQPQLQESGPGLVEASETLSLTCTVSGDSTAACDYFWGWVRQPPGKGLEWIGGLSHCAGYYNTGWTYHNPSLKSRLTISLDTPKNQVFLKLNSVTAADTAIYYCARFDGEVLVYHDWPKPAWVDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8445 - protein, 485 aa, Artificial Sequence
  Description of Artificial Sequence: Synthetic polypeptide
MKHLWFFLLLVAAPRWVLSQPQLQESGPGLVEASETLSLTCTVSGDSTGRCNYFWGWVRQPPGKGLEWIGSLSHCRSYYNTDWTYHNPSLKSRLTISLDTPKNQVFLRLTSVTAADTATYYCARFGGEVLVYRDWPKPAWVDLWGRGTLVVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8446 - protein, 478 aa, Artificial Sequence
  Description of Artificial Sequence: Synthetic polypeptide
MKHLWFFLLLVAAPRWVLSQVQLQESGPGLVKPAETLSLTCSVSGESINTGHYYWGWVRQVPGKGLEWIGHIHYTTAVLHNPSLKSRLTIKIYTLRNQITLRLSNVTAADTAVYHCVRSGGDILYYYEWQKPHWFSPWGPGIHVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8447 - protein, 483 aa, Artificial Sequence
  Description of Artificial Sequence: Synthetic polypeptide
MKHLWFFLLLVAAPRWVLSQLQLQESGPGLVKPSETLSLTCTVSGGSMRGTDWGENDFHYGWIRQSSAKGLEWIGSIHWRGRTTHYKTSFRSRATLSIDTSNNRFSLTFSFVTAADTAVYYCARHKYHDIFRVVPVAGWFDPWGQGLLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8448 - protein, 482 aa, Artificial Sequence
  Description of Artificial Sequence: Synthetic polypeptide
MKHLWFFLLLVAAPRWVLSQLQMQESGPGLVKPSETLSLSCTVSGDSIRGGEWGDKDYHWGWVRHSAGKGLEWIGSIHWRGTTHYKESLRRRVSMSIDTSRNWFSLRLASVTAADTAVYFCARHRHHDVFMLVPIAGWFDVWGPGVQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8449 - protein, 482 aa, Artificial Sequence
  Description of Artificial Sequence: Synthetic polypeptide
MKHLWFFLLLVAAPRCVLSEVHLEESGPGLVRPSETLSLTCTASGGSIRGGEWGDSDYHWGWVRHSPEKGLEWIGSIHWRGTTHYNAPFRGRGRLSIDLSRNQFSLRLTSVTAEDTAVYYCVKHKYHDIVMVVPIAGWFDPWGQGLQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8450 - protein, 123 aa, Artificial Sequence
  Description of Artificial Sequence: Synthetic polypeptide
EVQLVESGGGVVRPGNSLRLSCAASGIIFSTANLHWLRHVPGKGLEWVAIISYDGHRQYYADLVKGRFTISRDNSKNTLHLQMDGLTSDDTAVYYCAKDGADENNLGPAFDYWGRGTLVTVSS

SEQ ID NO: 8451 - protein, 485 aa, Artificial Sequence
  Description of Artificial Sequence: Synthetic polypeptide
MELGLSWVFLVVLLRGVHCQVHLVESGGGVVQPGKSLRLSCETSGFIFNQYPMYWVRQAPGKGPEWVAAISADAWHVDYPGSVRGRFTVSRDNSKSSLYLDMKSLKVEDTAIYFCAKDGEEHKVPQLHSWSGRNLYHYTGFDVWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISICAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8452 - protein, 484 aa, Artificial Sequence
  Description of Artificial Sequence: Synthetic polypeptide
MELGLSWVFLVGLLRGVQCRVQLVESGGGVVQPGKSVRLSCVVSDFPFSKYPMYWVRQAPGKGLEWVAAISGDAWHVVYSNSVQGRFLVSRDNVKNTLYLEMNSLKIEDTAVYRCARMFQESGPPRLDRWSGRNYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8453 - protein, 484 aa, Artificial Sequence
  Description of Artificial Sequence: Synthetic polypeptide
MELGLSWVFLVALLRGVQCQVQLVESGGGVVQPGKSLRLSCVVSNFIFNKYPMYWVRQAPGKGLEWVAAISADAWHVDYAASVKDRFLISRDNSKNALYLEMNTLRVEDTGIYYCARNIEEFSVPQFDSWSGRSYYHYFGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8454 - protein, 484 aa, Artificial Sequence
  Description of Artificial Sequence: Synthetic polypeptide
MELGLSWVFLVALLRGVHCEVRLMESGGGVVQPGKSLRLSCVTSGFIFKKYPMYWIRQAPGKGLEWVAAISADAWHVDYPGSVRGRFTVSRDNSKNSLYLDMNSLTVEDTAIYFCAKDGEEHEVPQLHSWSGRNLYHYTGVDVWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8455 - protein, 486 aa, Artificial Sequence
  Description of Artificial Sequence: Synthetic polypeptide
MELGLSWVFLVGLLRGVHCRVQLVESGGGVVQPGKSVRLSCVVSDFPFSKYPMYWVRQAPGKGLEWVAAISADAWHVVYSGSVQGRFLVSRDNSKNILYLEMNTLKIEDTAVYRCARMFQESGPPRFDSWSGRNYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDICRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTICNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8456 - protein, 484 aa, Artificial Sequence
  Description of Artificial Sequence: Synthetic polypeptide
MELGLSWVFLVALLRGVQCQVQLVESGGGVVQPGKSLRLSCVVSNFLFNKRHMHWVRQAPGKGLEWIAVISSDAIHVDYASSVRGRSLISRDNSKNSLYLDMNNLKIEDTATYYCARDRDGYGPPQIQTWSGRYLHLYSGIDAWGLGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8457 - protein, 491 aa, Artificial Sequence
  Description of Artificial Sequence: Synthetic polypeptide
MELGLSWVFLVALLRGVHCEVHLVESGGGVVQPGKSLRLSCVTSGFIFKQYPMYWIRQAPGKGLEWVAAISADAWHVDYAGSVRGRFTVSRDNSICNSLYLDMNSLTVEDTAIYFCAKDGEEHEVPQLHSWSGRNLYHYTGVDIWGPGTTVTVSSASTKGPSVFPLAPSSKSTSGGTAALGCLVICDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPICPKDTLMISRTPEVTCVVVDVSHEDPEVICFNWYVDGVEVHNAKTICPREEQYNSTYRVVSVLTVLHQDWLNGICEYKCKVSNKALPAPIEKTISICAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8458 - protein, 484 aa, Artificial Sequence
  Description of Artificial Sequence: Synthetic polypeptide
MELGLSWVFLVVLLRGVHCQVHLVESGGGVVQPGKSLRLSCETSGFIFNEYPMYWIRQAPGKGPEWVAAISADAWHVDYAGSVRGRFTVSRDNSKNSLYLDMKSLKVEDTAIYFCAKDGEEHKVPQLHSWSGRNLYHYTGFDVWGPGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8459 - protein, 130 aa, Artificial Sequence
  Description of Artificial Sequence: Synthetic polypeptide
QGQLVQSGAELKKPGDSVKISCKTSGYRFNFYHIWIRQTAGRGPEWMGWISPYSGDKNLAPAFQDRVIMTTDNEVPVTAFTSTGTAYMEIRNLRFDDTGIYFCAKGLLRDGSSTWLPYLWGQGTLLTVSS

SEQ ID NO: 8460 - protein, 130 aa, Artificial Sequence
  Description of Artificial Sequence: Synthetic polypeptide
QGQLVQSGGELKKPGASVKISCKTSGYRFSFYHIWIRQVSGRGPEWMGWISPYSGDTNLAPDFRGRVVLTTDREVVDTMTMSTGTAHMELRNLKSDDTGLYFCAKGLLRDGSSTWLPHLWGQGTLLTVSS

SEQ ID NO: 8461 - protein, 118 aa, Artificial Sequence
  Description of Artificial Sequence: Synthetic polypeptide
QVQLQQSGPELVKPGASVRMSCKASGYTFTDYVIHWVKQRTGQGLEWIGEIYPGSGSAYSNAKFKDKATLTADKSSNTAYMQLSSLTSEDSAVYFCARRGNGTGFAYWGQGTLVTVSA

SEQ ID NO: 8462 - protein, 118 aa, Artificial Sequence
  Description of Artificial Sequence: Synthetic polypeptide
QVQLVQSGPELKKPGASVKVSCKASGYTFTDYVIHWVKQATGQGLEWIGEIYPGSGSAYSNAKFKDRVTMTADKSSNTAYMELSSLTSDDTAVYFCARRGNGTGFAYWGQGTLVTVSS

SEQ ID NO: 8463 - protein, 118 aa, Artificial Sequence
  Description of Artificial Sequence: Synthetic polypeptide
QVQLVQSGAEVKKPGASVKVSCKASGYTFTDYVIHWVRQATGQGLEWIGEIYPGSGSAYSNAKFKDRVTITADKSTNTAYMELRSLRSDDTAVYFCARRGNGTGFAYWGQGTLVTVSS

SEQ ID NO: 8464 - protein, 118 aa, Artificial Sequence
  Description of Artificial Sequence: Synthetic polypeptide
QVQLVQSGAEVKKPGASVKVSCKASGYTFTDYVIHWVKQATGQGLEWIGEIYPGSGSAYSNAKFKDRVTITADKSTNTAYMELRSLRSDDTAVYFCARRGNGTGFAYWGQGTLVTVSS

SEQ ID NO: 8465 - protein, 118 aa, Artificial Sequence
  Description of Artificial Sequence: Synthetic polypeptide
QVQLVQSGAEVKKPGASVKVSCKASGYTFTDYVIHWVRQATGQGLEWIGEIYPGSGSAYSNSKFKDRVTITADKSTNTAYMELRSLRSDDTAVYFCARRGNGTGFAYWGQGTLVTVSS

SEQ ID NO: 8466 - protein, 486 aa, Artificial Sequence
  Description of Artificial Sequence: Synthetic polypeptide
MEFGLSWVFLVAIIIGVQCQVQLVQSGAEVKKPGASVKVSCQASGYRFSNFVIHWVRQAPGQRFEWMGWINPYNGNKEFSAKFQDRVTFTADTSANTAYMELRSLRSADTAVYYCARVGPYSWDDSPQDNYYMDVWGQGTTVIVSSASLTSPKVFPLSLDSTPQDGNVVVACLVQGFFPQEPLSVTWSESGQNVTARNFPPSQDASGDLYTTSSQLTLPATQCPDGKSVTCHVKHYTNSSQDVTVPCRVPPPPPCCHPRLSLHRPALEDLLLGSEANLTCTLTGLRDASGATFTWTPSSGKSAVQGPPERDLCGCYSVSSVLPGCAQPWNHGETFTCTAAHPELKTPLTANITKSGNTFRPEVHLLPPPSEELALNELVTLTCLARGFSPKDVLVRWLQGSQELPREKYLTWASRQEPSQGTTTYAVTSILRVAAEDWKKGETFSCMVGHEALPLAFTQKTIDRLAGKPTHINVSVVMAEADGTCY

SEQ ID NO: 8467 - protein, 96 aa, Artificial Sequence
  Description of Artificial Sequence: Synthetic polypeptide
QVQLVQSGAEVKKPGASVKVSCKASGYTFTKYGMNWVRQAPGQGLKWMGWKNTNTGESTHVEEFKGRVTMSLDTSTNTAYMELSSLRSEDTAVYYC

SEQ ID NO: 8468 - protein, 118 aa, Artificial Sequence
  Description of Artificial Sequence: Synthetic polypeptide
QVQLVQSGAEVKKPGASVKVSCKASGYTFTEYTMHWVRQAPGQGLEWIGGINPNNGDTSYTQKFKGKATMTVDTSTNTAYMELSSLRSEDTAVYYCATPYYAYAIDSWGQGTLVTVSS

SEQ ID NO: 8469 - protein, 123 aa, Artificial Sequence
  Description of Artificial Sequence: Synthetic polypeptide
QEQLVESGGGVVQPGRSLRLSCEASGFIFSAFVLHWVRQAPGKGLEWVAVVWYDGNSKYYADSVKGRFTISRDTSQNTLHLQMDSLRPEDTAVYYCAREWVADDDTFDGFDVWGQGTMVTVSS

SEQ ID NO: 8470 - protein, 226 aa, Artificial Sequence
  Description of Artificial Sequence: Synthetic polypeptide
ESGGGVVQPGRSLRLSCAASGFSLSTYAIHWVRQAPGKGLEWVAVISHNGNIEYFGDSVRGRFSISRDNSKNTVYLHMNSLTTEDTAVYYCARDPRYYDAWSGPQLYYYYMDVWGKGTTVTVSSASPTSPKVFPLSLDSTQPDGNVVIACLVQGFFPQEPLSVTWSESGQGVTARDFPPSQDASGDLYTTSSQLTLPATQCLAGKSVTCHVKHYTNPSQDVTVPCP

SEQ ID NO: 8471 - protein, 119 aa, Artificial Sequence
  Description of Artificial Sequence: Synthetic polypeptide
EVQLVQSGAEVKKPGESLKISCYGSGYNFNDYWIGWVRQMPGKGLEWMGMIYPDDSDTKYSAAFEGQVTLSADKSISTAYLQWTSLRASDTATYYCARLDGDYADFDSWGQGTLVTVSS

SEQ ID NO: 8472 - protein, 127 aa, Artificial Sequence
  Description of Artificial Sequence: Synthetic polypeptide
QMKLMQSGGVMVRPGESATLSCVASGFDFSRNGFEWLRQGPGKGLQWLATVTFESKTHVTASARGRFTISRDNSRRTVYLQMTNLQPDDTAMYFCVKDQTIFHKNGAVDFFSYFDLWGRGAPVIVSA

SEQ ID NO: 8473 - protein, 122 aa, Artificial Sequence
  Description of Artificial Sequence: Synthetic polypeptide
QVQLVQSGAEVKKPGSSVKVSCKTSGGTFNRLAMSWVRQAPGQGLEWMGGIMPIFDITNYAQKFQGRVTIITDESTSTAYMELRSLTSEDSAVYYCARASYSSSSPYAFDIWGQGTMVTVSS

SEQ ID NO: 8474 - protein, 353 aa, Artificial Sequence
  Description of Artificial Sequence: Synthetic polypeptide
ASLTSPKVFPLSLCSTQPDGNVVIACLVQGFFPQEPLSVTWSESGQGVTARNFPPSQDASGDLYTTSSQLTLPATQCLAGKSVTCHVKHYTNPSQDVTVPCPVPSTPPTPSPSTPPTPSPSCCHPRLSLHRPALEDLLLGSEANLTCTLTGLRDASGVTFTWTPSSGKSAVQGPPDRDLCGCYSVSSVLSGCAEPWNHGKTFTCTAAYPESKTPLTATLSKSGNTFRPEVHLLPPPSEELALNELVTLTCLARGFSPKDVLVRWLQGSQELPREKYLTWASRQEPSQGTTTFAVTSILRVAAEDWKKGDTFSCMVGHEALPLAFTQKTIDRLAGKPTHVNVSVVMAEVDGTCY

SEQ ID NO: 8475 - protein, 125 aa, Artificial Sequence
  Description of Artificial Sequence: Synthetic polypeptide
EVQLVESGGGLVQAGDSLRLSCAASGRTFSFDAKGWFRQAPGKEREFVAAINWSGSDTHYADSVKGRFTISRDNAKNTAYLQMNSLKPEDTAVYYCAAAFDYSGSYDSVGLWDYWGQGTQVTVSS

SEQ ID NO: 8476 - protein, 125 aa, Artificial Sequence
  Description of Artificial Sequence: Synthetic polypeptide
EVQLVESGGGLVQAGDSLRLSCAASGRTFSFDARGWFRQAPGKEREFVAAINWSGSDTHYADSVKGRFTISRDNAKNTAYLQMNSLKPEDTAVYYCAAAFDYSGSYASVGLWDYWGQGTQVTVSS

SEQ ID NO: 8477 - protein, 125 aa, Artificial Sequence
  Description of Artificial Sequence: Synthetic polypeptide
EVQLVESGGGLVQAGDSLRLSCAASGRTFSFDARGWFRQAPGKEREFVAAINWSGSDTHYADSVKGRFTISRDNAKNTLYLQMNSLKPEDTAVYYCAAAFDYSGSYNSVGLWDYWGQGTQVTVSS

SEQ ID NO: 8478 - protein, 125 aa, Artificial Sequence
  Description of Artificial Sequence: Synthetic polypeptide
EVQLVESGGGLVQAGDSLRLSCAASGRTFSFDARGWFRQAPGKEREFVAAINWCGSDAHYADSVKGRFTISRDNAKNTAYLQMNSLKPEDTAVYFCAAAFDYSGSYNSVGLWDYWGQGTQVTVSS

SEQ ID NO: 8479 - protein, 125 aa, Artificial Sequence
  Description of Artificial Sequence: Synthetic polypeptide
EVQLVESGGGLVRHGDSLRLSCAASRRTTSVYATGWFRQAPGKEREFVAAISWSGGYTNYADSVKGRFTISRDNARNTVFLQMNSLKPEDTAVYYCAADRNPYRGSNNANAYDYWGQGTQVTVSS

SEQ ID NO: 8480 - protein, 125 aa, Artificial Sequence
  Description of Artificial Sequence: Synthetic polypeptide
EVQLVESGGGLVQAGDSLRLSCAASGRTFSFDARGWFRQAPGKEREFVAAINWSGSDTHYADSVKGRFTISRDNAKNTVYLQMNSLKPEDTAVYYCAAAFDYSGSYDSVGLWDYWGQGTQVTVSS

SEQ ID NO: 8481 - protein, 125 aa, Artificial Sequence
  Description of Artificial Sequence: Synthetic polypeptide
EVQLVESGGGLVRHGDSLRLSCLVSGRTTSVYATGWFRQAPGKEREFVAAISWSGGYTNYADSVKGRFTISRDNAKNTVFLQMNSLKPEDTAVYYCAADRNPYRGSNNANAYDYWGQGTQVTVSS

SEQ ID NO: 8482 - protein, 125 aa, Artificial Sequence
  Description of Artificial Sequence: Synthetic polypeptide
EVQLVESGGGWVQAGDSLRLSCAASGRTFSFDAKGWFRQAPGKEREFVAAINWSGSDTHYADSVKGRFTISRDNAKNTVYLQMNSLKPEDTAVYYCAAAFDYSGSYNSVGLWDYWGQGTQVTVSS

SEQ ID NO: 8483 - protein, 125 aa, Artificial Sequence
  Description of Artificial Sequence: Synthetic polypeptide
EVQLVESGGGWVQAGDSLRLSCAASGRTFSFDAKGWFRQAPGKEREFVAAINWSGSDTHYADSVKGRFTISRDNAKNTVYLQMNSLKPEDTAVYYCAAAFDYSGNYNSVGLWDYWGQGTQVTVSS

SEQ ID NO: 8484 - protein, 125 aa, Artificial Sequence
  Description of Artificial Sequence: Synthetic polypeptide
EVQLVESGGGLVQAGDSLRLSCAASGRTFSFDARGWFRQAPGKEREFVAAINWSGSDAHYADSVKGRFTISRDNAKNTAYLQMNSLKPEDTAVYFCAAAFDYSGSYNSVGLWDYWGQGTQVTVSS

SEQ ID NO: 8485 - protein, 125 aa, Artificial Sequence
  Description of Artificial Sequence: Synthetic polypeptide
EVQLVESGGGLVQAGDSLRLSCAASGRTFSFDARGWFRQAPGKEREFVAAINWSGSDAHYADSVKGRFTISRDNAKNTAYLQMNSLKPEDTAAYFCAAAFDYSGSYNSVGLWDYWGQGTQVTVSS

SEQ ID NO: 8486 - protein, 125 aa, Artificial Sequence
  Description of Artificial Sequence: Synthetic polypeptide
EVQLVESGGGLVQAGDSLRLSCAASGRSFSFDARGWFRQAPGKEREFVAAINWSGSDTHYADSVKGRFTISRDNAKNTAYLQMNSLKPEDTAVYYCAAAFDYSGSYNSVGLWDYWGQGTQVTVSS

SEQ ID NO: 8487 - protein, 125 aa, Artificial Sequence
  Description of Artificial Sequence: Synthetic polypeptide
EVQLVESGGGLVRHGDSLRLSCAASRRTTSVYATGWFRQAPGKEREFVAAISWSGGYTNYADSVKGRFTISRDNAKDTVFLQMNSLKPEDTAVYYCAADRNPYRGSNNANAYDYWGQGTQVTVSS

SEQ ID NO: 8488 - protein, 125 aa, Artificial Sequence
  Description of Artificial Sequence: Synthetic polypeptide
EVQLVESGGGLVRHGDSLRLSCLVSRRTTSVYATGWFRQAPGKEREFVAAISWSGGYTNYADSVKGRFTISRDNAKNTVFLQMNSLKPEDTAVYYCAADQNPYRGSNNANAYDYWGQGTQVTVSS

SEQ ID NO: 8489 - protein, 125 aa, Artificial Sequence
  Description of Artificial Sequence: Synthetic polypeptide
EVQLVESGGGLVRHGDSLRLSCAASRRTTSVYATGWFRQAPGKEREFVAAISWSGGYTNYADSVKGRFTISRDNAKNTVFLQMNSLKPEDTAVYYCAADRNPYRGSNNANAYDYWGQGTQVTVSS

SEQ ID NO: 8490 - protein, 125 aa, Artificial Sequence
  Description of Artificial Sequence: Synthetic polypeptide
EVQLVESGGGLVQAGDSLRLSCAASGRTFSFDAKGWFRQAPGKEREFVAAINWSGSDTHYADSVKGRFTISRDNAKNTVYLQMNSLKPEDTAVYYCAAAFDYSGSYDSVGLWDYWGQGTQVTVSS

SEQ ID NO: 8491 - protein, 125 aa, Artificial Sequence
  Description of Artificial Sequence: Synthetic polypeptide
EVQLVESGGGLVRHGDSLRLSCLVSRRTTSVYATGWFRQAPGKEREFVAAISWSGGYTNYADSVKGRFTISRDNARNTVFLQMNSLKPEDTAVYYCAADRNPYRGSNNANAYDYWGQGTQVTVSS

SEQ ID NO: 8492 - protein, 120 aa, Artificial Sequence
  Description of Artificial Sequence: Synthetic polypeptide
EVQLVESGGGLVQPGGSLRLSCAASGFTLDYYAIGWFRQAPGKEREGVSCVSSSDGSTYYADSVKGRFTISRDNAENTVYLQMNSLKPEDTAVYYCATEQSCTGSSWSGPGQGTRVTVSS

SEQ ID NO: 8493 - protein, 125 aa, Artificial Sequence
  Description of Artificial Sequence: Synthetic polypeptide
EVQLVESGGGLVQAGDSLRLSCAASGRTFSFDARGWFRQAPGKEREFVAAINWSGSDAHYADSVKGRFTISRDNAKNTAYLRMNSLKPEDTAVYFCAAAFDYSGSYNSVGLWDYWGQGTQVTVSS

SEQ ID NO: 8494 - protein, 123 aa, Artificial Sequence
  Description of Artificial Sequence: Synthetic polypeptide
EVQLVESGGGLVQAGGSLRLSCRASGNTGNVNAMGWYRQAPGKQRELVAAVSGGGKTNYADSVKGRFTISIDNAKIIVYLQMNNLKPEDTAVYYCNAGVMGTSGSYYLGEDNWGQGTQVTVSS

SEQ ID NO: 8495 - protein, 125 aa, Artificial Sequence
  Description of Artificial Sequence: Synthetic polypeptide
EVQLVESGGGLVQAGDSLRLSCAASKRTTSAYATGWFRQAPGKEREFVAAISYSGAYTNYADSVKGRFTISRDNAKNTVYLQMNSLKPEDTAVYYCAADRNPYRGSNNANAYDYWGQGTQVTVSS

SEQ ID NO: 8496 - protein, 125 aa, Artificial Sequence
  Description of Artificial Sequence: Synthetic polypeptide
EVQLVESGGGLVRHGDSLRLSCLVSRRTTSVYATGWFRQAPGKEREFVAAISWSGGYTNYADSVKGRFTISRDNAKNTVFLQMNSLKPEDTAVYYCAADRNPYRGSNNANAYDYWGQGTQVTVSS

SEQ ID NO: 8497 - protein, 119 aa, Artificial Sequence
  Description of Artificial Sequence: Synthetic polypeptide
EVQLVESGGGLVQPGGSLRLSCAASGSIFSFNAMAWYRQAPGKQRELVAAISSGGSTNYADSVKGRFTISRDNAKNTVYLQMNSLKPEDTADYYCNLWHTDFVSFYDYWGQGTQVTVSS

SEQ ID NO: 8498 - protein, 128 aa, Artificial Sequence
  Description of Artificial Sequence: Synthetic polypeptide
EVQLVESGEGLVQAGDSLRLSGAASGRTISSYAMGWFRQAPGKEREFVAAVSMSGGRTLYADSVKGRFTISKDNTENTVYLQMNSLKPEDTAVYYCAAKVVGYFDVALYAQERDYNYWGQGTQVTVSS

SEQ ID NO: 8499 - protein, 124 aa, Artificial Sequence
  Description of Artificial Sequence: Synthetic polypeptide
EVQLVESGGGLVQAGGSLRLSCAASGRTFSDDLISWFRQAPGKERDFVAAVTFYGEDTYYADSVKGRFTISRDNAKNTVYLQMDRLKSEDTAVYHCASSSRATVIQNPLGYDYWGQGTQVTVSS

SEQ ID NO: 8500 - protein, 123 aa, Artificial Sequence
  Description of Artificial Sequence: Synthetic polypeptide
EVLVESGGGLVQAGGSLRLSGAASGRTFSNDLISWFRQAPGKERDFVAGVAFYGDDTYYADSVKGRFTISRENAKNRVYLQMDNLKSEDTGVYYCASSSRASVIQNPLGYDYWGQGTKVTVSS

SEQ ID NO: 8501 - protein, 124 aa, Artificial Sequence
  Description of Artificial Sequence: Synthetic polypeptide
EVQLVESGGGLVQAGGSLRLSCAASGRTFSNDLISWFRQAPGEERDFVAAVAFYGDDTYYADSVKGRFTISRDNAKNTVYLQMDNLKSEDTAVYYCASSSRATVIQNPLGYDYWGQGTQVTVSS

SEQ ID NO: 8502 - protein, 127 aa, Artificial Sequence
  Description of Artificial Sequence: Synthetic polypeptide
EVQLVESGGGLVQAGDSLRLSCAASGRTISSYAMGWFRQAPGKEREFVAAVSMSGGRTLYADSVKGRFTISKDNTENTVYLQMNSLKPEDTAVYYCAAKWGYFDVALYAQERDYNYWGQGTQVTVSS

SEQ ID NO: 8503 - protein, 125 aa, Artificial Sequence
  Description of Artificial Sequence: Synthetic polypeptide
EVQLVESGGGLVQAGGSLRLACAASGRTFSDYAVGWFRQAPGKERQIVAAISWGGGDTYYTNSVKGRFTISRDNTRNTVYLQMSSLKPEDTAVYYCAANRNRRGVVSAPSSYDYWGQGTQVTVSS

SEQ ID NO: 8504 - protein, 126 aa, Artificial Sequence
  Description of Artificial Sequence: Synthetic polypeptide
EVQLVESGGGLVQAGGSLRLSCAASGFTSDDYAIGWFRQAPGKEREGVSYISHEDGSTYVADSVGGRFTISYDYAENTVYLQMNSLKPDDTAVYYCAAAILGNSVLWLWEYEYRYWGQGTQVTVSS

SEQ ID NO: 8505 - protein, 126 aa, Artificial Sequence
  Description of Artificial Sequence: Synthetic polypeptide
EVQLVESGGGLVQAGGSLRLSCAASGFTLDDYAIGWFRQAPGKEREKVSFMFTSDGSGWYADSVKGRFTISSNNAKNTVYLEMNRLKPEDTAVYYCAAAYAGELVLWLPDYDYNYWGQGTQVTVSS

SEQ ID NO: 8506 - protein, 126 aa, Artificial Sequence
  Description of Artificial Sequence: Synthetic polypeptide
EVQLVESGGGLVQAGGSLGLSCAASGFTSDDYAIGWFRQAPGKEREGVSYISHEDGSTYVADSVRGRFTISYDYAKNTVYLQMNSLKPEDTAVYYCAAAILGNSVLWLWEYEYRYWGQGTQVTVSS

SEQ ID NO: 8507 - protein, 126 aa, Artificial Sequence
  Description of Artificial Sequence: Synthetic polypeptide
EVQLVESGGGLVQAGGSLRLSCAASGFTSDDYAIGWFRRAPGKEREGVSYVSIEDGSTYTADSVKGRFTISSDNAENTVYLQMNSLKPEDTAVYYCAAAILGDYVRWLQEYDYDYWGQGTQVTVSS

SEQ ID NO: 8508 - protein, 126 aa, Artificial Sequence
  Description of Artificial Sequence: Synthetic polypeptide
EVQLVESGGGLVQAGGSLRLSCAASGFTSDDYAIGWFRQAPGKEREGVSYISHEDGSTYVADSVRGRFTISSDYAKNTVYLQMNSLKPEDTAVYYCAAAILGNSVLWLWEYEYRYWGQGTQVTVSS

SEQ ID NO: 8509 - protein, 126 aa, Artificial Sequence
  Description of Artificial Sequence: Synthetic polypeptide
EVQLVESGGGLVQAGGSLRLSCAASGFTSDDYAIGWFRRAPGKEREGVSYISIEDGSTYTADSVKGRFTISSDNAKNTVYLQMNSLKPEDTAVYYCAAAILGDYVRWLQEYDYDYWGQGTQVTVSS

SEQ ID NO: 8510 - protein, 126 aa, Artificial Sequence
  Description of Artificial Sequence: Synthetic polypeptide
EVQLVESGGGLVQPGGSLRLSCAASGFTSDDYAIGWFRQAPGKEREGVSYISHEDGSTYVADSVRGRFTISYDYAKNTVYLQMNSLKPEDTAVYYCAAAILGNSVLWLWEYEYRYWGQGTQVTVSS

SEQ ID NO: 8511 - protein, 125 aa, Artificial Sequence
  Description of Artificial Sequence: Synthetic polypeptide
EVQLVESGGGLVQAGGSLRLSCVLSGGTLSDAAMGWFRQPPGKEREFVAAISWSAGPTTHYADSVKGRFTISRDDAKNTVYLQMNSLKPEDTGVYYCAAQFRVGWVHLSNEYDYWGQGTQVTVSS

SEQ ID NO: 8512 - protein, 126 aa, Artificial Sequence
  Description of Artificial Sequence: Synthetic polypeptide
EVQLVESGGGLVQAGGSLRLSCAASGFTSDDYAIGWFRRAPGKEREGVSYISIEDGSMYYANSVKGRFTISSDNAKKTVYLQMNSLKVEDTAIYYCAAAIFGDSVRWLSEYEYNYWGQGTQVTVSS

SEQ ID NO: 8513 - protein, 126 aa, Artificial Sequence
  Description of Artificial Sequence: Synthetic polypeptide
EVQLVESGGGLVQAGGSLRLSCAASGFTSDDYAIGWFRQAPGKEREGVSYISHEDGSTYVADSVRGRFTISYDYAKNTVYLQMNSLKPEDTAVYYCAAAILGNSVLWLWEYEYRYWGQGTQVTVSS

SEQ ID NO: 8514 - protein, 126 aa, Artificial Sequence
  Description of Artificial Sequence: Synthetic polypeptide
EVQLVESGGGLVQAGGSLRLSCVCSGFSSDEYAIGWFRQAPGKEREGVSYISREDGSRHYADSVKGRFTISTDYARNTVYLQMDSLKPEDTGVYYCAAALLGDYVLWLPEYPYNYWGQGTQVTVSS

SEQ ID NO: 8515 - protein, 131 aa, Artificial Sequence
  Description of Artificial Sequence: Synthetic polypeptide
EVQLVESGGDSVQPGGSLRLSCAASGFAYGTLDDYTIGWFRQVPGKEREGVACIGHNDDTTYYADSVQGRFTISRDNAKNTVYLQMSSLKPEDTAVYLCASTSRARCARYSYNDRWFFDTWGQGTQVTVSS

SEQ ID NO: 8516 - protein, 122 aa, Artificial Sequence
  Description of Artificial Sequence: Synthetic polypeptide
EVQLVESGGGLVQAGDSLRLSCAASTRTFRNYNLGWFRQAPGKEREFVAAISWADYRTFYSDSAKGRFTISRDNTKNMLYLQMNSLKPEDTARYYCGAGYRDVRVDWQPAFWGQGTQVTVSS

SEQ ID NO: 8517 - protein, 118 aa, Artificial Sequence
  Description of Artificial Sequence: Synthetic polypeptide
EVQLVESGGGLVQAGDSLRLSCTASGSQFSHTDMAWARQPPGKEREFVAINWSAGNTYYRDSVKGRFTISRDNAQNTVYLQMNSLKPEDTATYYCAARIGYDVDWNYWGQGTQVTVSS

SEQ ID NO: 8518 - protein, 129 aa, Artificial Sequence
  Description of Artificial Sequence: Synthetic polypeptide
EVQLVESGGGLVQAGGSLRLSCTASGTTFFMYAMGWFRQAPGKEREFVAAISRFGDSLHSSDSVKGRFTISRDNTENTVYLQMNMVKPEDTAVYYCAAKVAYHRSGSRYYTNHTDYDAWGQGTQVTVSS

SEQ ID NO: 8519 - protein, 133 aa, Artificial Sequence
  Description of Artificial Sequence: Synthetic polypeptide
EVQLVESGGGLVQAGGSLRLSCTVSGQTSTTDAVGWFRQAPGKEREFVSAISWSDNKLYYEDSVKGRFAISRDNAKDTVYLQMDSLKPEDTAVYYCAARNRPPDFLTNYFRVLYYREGAYDYWGQGTQVTVSS

SEQ ID NO: 8520 - protein, 128 aa, Artificial Sequence
  Description of Artificial Sequence: Synthetic polypeptide
EVQLVESGGGLVQAGGSLRLSCAASGFSLDDYAIGWFRQAPGKEREGLSCRSGSDGSTYYADSVKGRFTFSSDNAKNTVYLQLNSLKPEDTAVYYCALITGSSYCLWRRILESEFDVWGQGTQVTVSS

SEQ ID NO: 8521 - protein, 127 aa, Artificial Sequence
  Description of Artificial Sequence: Synthetic polypeptide
EVQLVESGGGVVQAGGSLRLSCAASGRTFSLYTMGWFRQAPGKEREFIAHMRRGGYTTYVADSVKDRFTISGDNAEATVYLQMNSLKSEDTAVYYCAAKLGLLVIGTAPTANDYDYWGQGTQVTVSS

SEQ ID NO: 8522 - protein, 126 aa, Artificial Sequence
  Description of Artificial Sequence: Synthetic polypeptide
EVQLVESGGGLVQAGGSLRLSCAASGFTSDDYAIGWFRRAPGKEREGVSYISIEDGSTYSADSVKGRFTISSDYAKNTVYLQMNGLKPEDTAVYYCAAAILGDSVRWLQEYDYDYWGQGTQVTVSS

SEQ ID NO: 8523 - protein, 120 aa, Artificial Sequence
  Description of Artificial Sequence: Synthetic polypeptide
EVQLVESGGDLVQAGDSLRLSCVVSGSIRDNSVIGWFRQVPGKERKLFTYYYWSGTSTYFVEAVKGRFTISRDIKSKNTVYLQMNNLKEIEDTALYYCATTSEGIMIDISGQGTQVSFLS

SEQ ID NO: 8524 - protein, 121 aa, Artificial Sequence
  Description of Artificial Sequence: Synthetic polypeptide
EVQLVESGGGLVQAGGSLRLSCIVSESIFSRYAMGWFRQAPGKEREFVAGIGAVTHYGEFVKGRFTISRDSAKNTIYLQMSSLKPEDTAIYFCARSKNTYISYASNQYDVWGRGTQVTVSS

SEQ ID NO: 8525 - protein, 126 aa, Artificial Sequence
  Description of Artificial Sequence: Synthetic polypeptide
EVQLVESGGGLVQAGGSLRLSCAASGFTSDDYAIGWFRQAPGKEREGVSYISLEDGSTYVADSVRGRFTISYDYAKNTVYLQMNSLKPEDSAVYYCAAAILGNSVLWLWEYDYRYWGQGTQVTVSS

SEQ ID NO: 8526 - protein, 120 aa, Artificial Sequence
  Description of Artificial Sequence: Synthetic polypeptide
EVQLVESGGGLVQAGDSLRLSCAVSGSISGIKTIGWFRQFPGRERKLFGYYYWNGASTYLVDSVICGRFTISRDNAENTVYLQMNNLKPEDTAIYYCGAETEGHYDFEFWGQGTQVTVSS

SEQ ID NO: 8527 - protein, 126 aa, Artificial Sequence
  Description of Artificial Sequence: Synthetic polypeptide
EVQLVESGGGLVQAGGSLRLSCVLSGGTFSDAAMGWFRQPPGKEREFNTAAISWSAGPTTHYADSVKGRFTISRDDAKNTVYLQMNSLKPEDTGVYYCAAQFRVGWVHLSNEYDYWGQGTQVTVSS

SEQ ID NO: 8528 - protein, 126 aa, Artificial Sequence
  Description of Artificial Sequence: Synthetic polypeptide
EVQLVESGGGLVQAGGSLRLSCACSGFTSDDYAIGWFRQAPGKEREGVSYISREDGSRHYADSAKGRFTISSDYAKNTVYLQMNSLEPEDTAVYYCAAALLGDYVLWLPEYEYKYWGQGTQVTVSS

SEQ ID NO: 8529 - protein, 126 aa, Artificial Sequence
  Description of Artificial Sequence: Synthetic polypeptide
EVQLVESGGGLVQAGESLRLSCAASGFTSDDYAIGWFRQAPGKEREGVSYISHEDGSTYVADSVRGRFTISYDYAKNTVYLQMNSLKPEDTAVYYCAAAILGNSVLWLWEYEYRYWGQGTQVTVSS

SEQ ID NO: 8530 - protein, 126 aa, Artificial Sequence
  Description of Artificial Sequence: Synthetic polypeptide
EVQLVESGGGLVQAGGSLRLSCACSGFTSDDYAIGWFRQAPGKEREGVSYISREDGGRYYADSVKGRFTISSDNAKNTVYLQMNSLKPEDTAVYYCAAALLGDYVRWLPEYEYNYWGQGTQVTVSS

SEQ ID NO: 8531 - protein, 126 aa, Artificial Sequence
  Description of Artificial Sequence: Synthetic polypeptide
EVQLVESGGGLVQTGGSLRLSCAASGFTSDDHAIGWFRRAPGKEREGLSYISIEDGSTYTADSVKGRFTISSDNAKNTVYLQMNSLKPEDTAVYYCAAAILGDYVRWLQEYDYDYWGQGTQVTVSS

SEQ ID NO: 8532 - protein, 121 aa, Artificial Sequence
  Description of Artificial Sequence: Synthetic polypeptide
EVQLVESGGGLVQAGGSLRLSCVASGDIQFSWSSMAWFRQAPGKEREFVATISRSGSDVDYADSAKGRFTISRDNAKKMLYLQMNSLKPEDTATYYCAAARGLTAYEFQFWGQGTQVTVSS

SEQ ID NO: 8533 - protein, 126 aa, Artificial Sequence
  Description of Artificial Sequence: Synthetic polypeptide
EVQLVESGGGLVQAGGSLRLSCAASGFTSDDYAIGWFRQAPGKEREGVSYISNEDGSTYVADSVKGRFTISSDNAKNTVYLQMNSLKPEDTAAYYCAAAILGNSVRWLSEYDYDYWGQGTQVTVSS

SEQ ID NO: 8534 - protein, 118 aa, Artificial Sequence
  Description of Artificial Sequence: Synthetic polypeptide
EVQLVESGGGLVQAGDSLIMSCTASTPTFSTLAMAWFRQAPGKEREFVAGIVDGMDNYDYSVEGRFTISRDNRENTLYLQMDSLRPEDTAVYYCAARRRYYSSKYEYWGQGTQVTVSS

SEQ ID NO: 8535 - protein, 118 aa, Artificial Sequence
  Description of Artificial Sequence: Synthetic polypeptide
EVQLVESGGGLVQAGGSLRLSCAASFSSDNMGWFRQAPGKEREFIAAINWNGGTIVYADSVKGRFTISRDNAICNTVYLQMNSLKPEDTAVYYCAADSPGVVLSWDYWGQGTQVTVSS

SEQ ID NO: 8536 - protein, 126 aa, Artificial Sequence
  Description of Artificial Sequence: Synthetic polypeptide
EVQLVESGGGLVQAGGSLRLSCAASGFTSDDYAIGWFRQAPGKEREGVSYISAEDGSTYNADSVKGRFTISSDNAKNTVYLQMNSLKPEDTGVYYCAAALLGASVRWLSEYDYDYWGQGTQVTVSS

SEQ ID NO: 8537 - protein, 126 aa, Artificial Sequence
  Description of Artificial Sequence: Synthetic polypeptide
EVQLVESGGGLVQPGGSLRLSCAASGFTSDDYAIGWFRRAPGKEREGVSYISNEDGSTYHADPVKGRFTIYSDNAKRTVYLQMNSLKPEDTAVYYCAAATLGDYVRWLSEYDYNYWGQGTQVTVSS

SEQ ID NO: 8538 - protein, 126 aa, Artificial Sequence
  Description of Artificial Sequence: Synthetic polypeptide
EVQLVESGGGLVQAGGSLRLSCAASGFTSDDYAIGWFRQAPGKEREGVSYISAEDGSTYNADSVKGRFTISSDNAKNTVYLQMNSLKPEDTAVYYCAAALLGDSVRWLSEYDYDYWGQGTQVTVSS

SEQ ID NO: 8539 - protein, 123 aa, Artificial Sequence
  Description of Artificial Sequence: Synthetic polypeptide
EVQLVESGGGLVQSGDSLRLSCTISGIFFDLYSMAWFRQAPGKEREFVAAISSVGGMTDYADSVKGRFTISRDNARQTVYLQMNSLKPEDTAVYSCAARAHREIVRSYGYNYWGQGTQVTVSS

SEQ ID NO: 8540 - protein, 119 aa, Artificial Sequence
  Description of Artificial Sequence: Synthetic polypeptide
EVQLVESGGGSVQAGDSLKLSCTASTPTFSNLAMAWFRQAPGREREFVSGIVGDDITNYADFAEGRFTISRDNSKNTLYLQMDSLRPEDTAVYVCAARRRYYSSRYEYWGQGTQVTVSS

SEQ ID NO: 8541 - protein, 119 aa, Artificial Sequence
  Description of Artificial Sequence: Synthetic polypeptide
EVQLVESGGGLVQAGGSLRISCEYSGRTFSTHRMAWFRQAPGKDREFVASLKWSDGETTYADSVKGRFTISRENAENSLYLQMNNLEPGDTAVYFCAAGTWWPPSYDYWGQGTQVTVSS

SEQ ID NO: 8542 - protein, 126 aa, Artificial Sequence
  Description of Artificial Sequence: Synthetic polypeptide
EVQLVESGGGLVQAGGSLRLSCAASGFTSDDYAIGWFRQAPGKEREGVSYISHEDGSTYVADSVRGRFTISYDYAENTVYLQMNSLKPDDTAVYYCAAAILGNSVLWLWEYEYRYWGQGTQVTVSS

SEQ ID NO: 8543 - protein, 133 aa, Artificial Sequence
  Description of Artificial Sequence: Synthetic polypeptide
EVQLVESGGGLVQTGGSLRLSCTASGQTSIIDAVGWFRQAPGKEREFVSAISWSDNNIYYEDSVKGRFTISRDNAKDTVYLQMDSLKPEDTAVYYCAARNRPPDFLTNYFRVLYYREGAYDYWGQGTQVTVSS

SEQ ID NO: 8544 - protein, 130 aa, Artificial Sequence
  Description of Artificial Sequence: Synthetic polypeptide
EVQLVESGGGAVQPGDSLRLACTASGVTLDASRVTLDVYSIGWFRQAPGNEREAVSCISSSDGSTYYADSVKGRFTISRDDAKNTVYLQMNSLKPEDTAVYYCASDWSCEIVLYATADYWGQGTQVTVSS

SEQ ID NO: 8545 - protein, 121 aa, Artificial Sequence
  Description of Artificial Sequence: Synthetic polypeptide
EVQLVESGGGLVQAGGFLRLSCELRGSIFNQYAMAWFRQAPGKEREFVAGMGAVPHYGEFVKGRFTISRDNAKSTVYLQMNSLKPEDTAIYFCARSKSTYISYNSNGYDYWGRGTQVTVSS

SEQ ID NO: 8546 - protein, 121 aa, Artificial Sequence
  Description of Artificial Sequence: Synthetic polypeptide
EVQLVESGGGLVQAGDSLRLSCTLSGGTYGFTEYRIGWFRQAPGLEREFAASIAWHDDTYYADSVRGRFLISRDNAKNTVQLQMNSLKPEDTAVYYCAAGLPGSPRRYDYWGQGTQVTVSS

SEQ ID NO: 8547 - protein, 121 aa, Artificial Sequence
  Description of Artificial Sequence: Synthetic polypeptide
EVQLVESGGGLVQAGGSLRLSCAAAVSATRINAFGWYRQAPGKQRELVATILSDGNTNYADSVKGRFTISRDNTRNTVYLQMNGLKPEDTAVYVCNAELYYSDYLPTQTAWGQGTQVTVSS

SEQ ID NO: 8548 - protein, 128 aa, Artificial Sequence
  Description of Artificial Sequence: Synthetic polypeptide
EVQLVESGGGLVQAGGSWLSCAASGGTFRSYSMGWFRQAPGKEREFVGRITWTGSTSYADFVKGRFTISRDNAENMMYLQMNSLKPEDTAIYYCARDRTGLRYLTAQAMRDTNEYEYWGQGTQVTVSS

SEQ ID NO: 8549 - protein, 129 aa, Artificial Sequence
  Description of Artificial Sequence: Synthetic polypeptide
EVQLVESGGGLVQAGGSLRLSCAASGRSFRVYGMAWFRQAPGKEREFVGRITWTASTSYADSVKGRFTISRDSAMNVIYLQMNSLKPEDTAVYYCATDRVSARYLTAQAMRDTDEYDYWGQGTQVTVSS

SEQ ID NO: 8550 - protein, 129 aa, Artificial Sequence
  Description of Artificial Sequence: Synthetic polypeptide
EVQLVESGGGLVQAGGSLRLSCAASGRTINTYATGWFRQAPGKEREFVARISWGADSTNYADSVKGRFTISKDNAKNTVYLQMNSLKPEDTAVYYCAADKPYRALNLERMHDSSEYDVWGQGTQVTVSS

SEQ ID NO: 8551 - protein, 127 aa, Artificial Sequence
  Description of Artificial Sequence: Synthetic polypeptide
EVQLVESGGGLVQTGGSLTLSCATSEGTFSAYTMAWFRQAPGKEREFVGAIDWRFGNTYYADSVKGRFTISRDNARNTGYLQMNSLKPEDTAVYFCAADRYRSIPYPPRRDSVYEYWGQGTQVTVSS

SEQ ID NO: 8552 - protein, 120 aa, Artificial Sequence
  Description of Artificial Sequence: Synthetic polypeptide
EVQLVESGGGLVQPGGSLRLSCAASGSIFSMTGMGWYRQPPGKQRELVAAITTDGSTHYADSVKERFTISGDNAKKTLYLQMNSLKPEDTAVYYCYAPMIYDRGSYRDYWGQGTQVTVSS

SEQ ID NO: 8553 - protein, 126 aa, Artificial Sequence
  Description of Artificial Sequence: Synthetic polypeptide
EVQLVESGGGLVQPGGSLTLSCVASGFTLDGYAIGWFRQAPGKEVEPVSCITGRHGTIYYADSVMGRFTISRDNAKNTVYLQMNSLKPEDTAVYYCAADGFDTPCVAGTDWQYDYWGQGTQVTVSS

SEQ ID NO: 8554 - protein, 124 aa, Artificial Sequence
  Description of Artificial Sequence: Synthetic polypeptide
EVQLVESGGGLVQPGGSLRLSCAASGNIFGENTMNWYRQAPGKQRELVAGITNLQSAYYPDGVKYADSVKGRFTISRDNAKNAVYLQMNSLKPEDTAVYYCNIFEHRFPPATYWGQGTQVTVSS

SEQ ID NO: 8555 - protein, 125 aa, Artificial Sequence
  Description of Artificial Sequence: Synthetic polypeptide
EVQLVESGGGLVQPGGSLRLSCVASGFTLDGYAIGWFRQAPGKEREAISCITTAGTIYYADSVKGRVTISRDNAKNTVYLQMNSLKPEDTAVYLCAADGFDTPCVAGTDWGYDYEGQGTQVTVSS

SEQ ID NO: 8556 - protein, 116 aa, Artificial Sequence
  Description of Artificial Sequence: Synthetic polypeptide
EVQLVESGGGLVQPGGSLRLSCAASGPLFSISTMGWYRQAPGEQRELVASISSDGDTNYSDSVKDRFTISRDNAENTVYLQMNSLKPEDTAVYFCYARKWILDTYWGQGTQVTVSS

SEQ ID NO: 8557 - protein, 120 aa, Artificial Sequence
  Description of Artificial Sequence: Synthetic polypeptide
EVQLVESGGGLVQPGGSLRLSCTASGNIVSIDAAGWFRQAPGKQREPVATILTGGTTNYADSVKGRFTISRDTAKNIVYLQMNSLKPEDTAVYYCYAPMIYYGGSYSDYWGQGTQVTVSS

SEQ ID NO: 8558 - protein, 114 aa, Artificial Sequence
  Description of Artificial Sequence: Synthetic polypeptide
EVQLVESGGGLVQAGGSLRLSCTASGVTIDAVGWYRQAPGKQREPVATITSGGSTNYADSVKGRFTISRDDAKNTVYLQMNSLKPEDTAVYYCFRPGGPYSDSWGQGTQVTVSS

SEQ ID NO: 8559 - protein, 122 aa, Artificial Sequence
  Description of Artificial Sequence: Synthetic polypeptide
EVQLVESGGALVKAGGSLRLSCAVSGTSVSDNGMGWGRQAPGKQRELVAVLTSGGATNYAPSVKGRFTISRDNAKNAVYLQMNNLKPEDTAVYYCAADTAARSLYSDPFDVWGQGTQVTVSS

SEQ ID NO: 8560 - protein, 124 aa, Artificial Sequence
  Description of Artificial Sequence: Synthetic polypeptide
EVQLVESGGGLVQPGGSLRLSCAASGNILGENTMNWYRQAPGKERELVAGVTNLRSTYYPDGVKYADSVKGRFTVSRDNAKNAVYLQMNSLKPEDTAVYYCNLFEHRFPPATYWGQGTQVTVSS

SEQ ID NO: 8561 - protein, 120 aa, Artificial Sequence
  Description of Artificial Sequence: Synthetic polypeptide
EVQLVESGGALVQAGRSLRLSCAASGNAFTIDAAAWYRQAPGKQREPVATILSGGTTNYADSVKGRFTISRDNVKNTVYLQMNSLKPEDTAVYYCYVPMVYYSGRYNDVWGQGTQVTVSS

SEQ ID NO: 8562 - protein, 126 aa, Artificial Sequence
  Description of Artificial Sequence: Synthetic polypeptide
EVQLVESGGGLVQAGGSLRLSCAVSGGTFDDYAIGWFRQAPGKEREGVSYIGCNDGSTYYANSVKGRFTISCDYAKNTVYLQMNNLKPEDTAVYYCAAAAQWATIRWIQEYDYDYWGQGTQVTVSS

SEQ ID NO: 8563 - protein, 128 aa, Artificial Sequence
  Description of Artificial Sequence: Synthetic polypeptide
EVQLVESGGGLVQPGGSLRLSCAVSGFPLGYYAIGWFRQAPGKEREEVSCIVTSDGSTYYTDSVKGRFTISRDAAKNTVYLQMNNLNPEDTAVYYCAAGGTLVAVTDSCFIDYVMDYWGKGTLVTVSS

SEQ ID NO: 8564 - protein, 126 aa, Artificial Sequence
  Description of Artificial Sequence: Synthetic polypeptide
EVQLVESGGGLVQPGGSLRLSCAASGATFDDYAIGWFRQAPGKEREGVSYIGCNDGATYYAGSVKGRFTISCDYAKNTVYLQMNSLKPEDTAVYYCAAAAQWATIRWIHEYDYNIWGQGTQVTVSS

SEQ ID NO: 8565 - protein, 126 aa, Artificial Sequence
  Description of Artificial Sequence: Synthetic polypeptide
EVQLVESGGGLVQPGGSLKLSCAASGASFMDYAIGWFRQAPGKEREGVSYIGCEDGAQYYAGSVKGRFTISCDYAKNTVYLQMNSLKPEDTAVYYCAAAKQWETIRWVHEYDYHNWGQGTQVTVSS

SEQ ID NO: 8566 - protein, 126 aa, Artificial Sequence
  Description of Artificial Sequence: Synthetic polypeptide
EVQLVESGGGLVQPGGSLKLSCAASGAGFNDYAIGWFRQAPGKEREGVSYIGCLDGAQYYAGSVKGRFTISCDYAKNTVYLQMNSLKPEDTAVYYCAAAEQWNTIRWVHEYDYGDWGQGTQVTVSS

SEQ ID NO: 8567 - protein, 126 aa, Artificial Sequence
  Description of Artificial Sequence: Synthetic polypeptide
EVQLVESGGGLVQPGGSLKLSCAASGAAFDDYAIGWFRQAPGKEREGVSYIGCYDGAQYYAGSVKGRFTISCDYAKNTVYLQMNSLKPEDTAVYYCAAAYQWSTIRWVHEYDYNHLGQGTQVTVSS

SEQ ID NO: 8568 - protein, 126 aa, Artificial Sequence
  Description of Artificial Sequence: Synthetic polypeptide
EVQLVESGGGLVQPGGSLKLSCAASGASFHDYAIGWFRQAPGKEREGVSYIGCDDGAQYYAGSVKGRFTISCDYAKNTVYLQMNSLKPEDTAVYYCAAAYQWDTIRWVHEYDYSVWGQGTQVTVSS

SEQ ID NO: 8569 - protein, 126 aa, Artificial Sequence
  Description of Artificial Sequence: Synthetic polypeptide
EVQLVESGGGLVQPGGSLKLSCAASGAAFHDYAIGWFRQAPGKEREGVSYIGCTDGAQYYAGSVKGRFTISCDYAKNTVYLQMNSLKPEDTAVYYCAAADQWNTIRWVHEYDYVYWGQGTQVTVSS

SEQ ID NO: 8570 - protein, 126 aa, Artificial Sequence
  Description of Artificial Sequence: Synthetic polypeptide
EVQLVESGGGLVQPGGSLKLSCAASGAPFMDYAIGWFRQAPGKEREGVSYIGCADGAQYYAGSVKGRFTISCDYAKNTVYLQMNSLKPEDTAVYYCAAADQWTTIRWVHEYDYHVWGQGTQVTVSS

SEQ ID NO: 8571 - protein, 126 aa, Artificial Sequence
  Description of Artificial Sequence: Synthetic polypeptide
EVQLVESGGGLVQPGGSLKLSCAASGANFADYAIGWFRQAPGKEREGVSYIGCDDGAQYYAGSVKGRFTISCDYAKNTVYLQMNSLKPEDTAVYYCAAATQWNTIRWVHEYDYVFWGQGTQVTVSS

SEQ ID NO: 8572 - protein, 126 aa, Artificial Sequence
  Description of Artificial Sequence: Synthetic polypeptide
EVQLVESGGGLVQPGGSLRLSCAASGADFDDYAIGWFRQAPGKEREGVSYIGCDDGAQYYAGSVKGRFTISCDYAKNTVYLQMNSLKPEDTAVYYCAAANQWTTIRWVHEYDYDIWGQGTQVTVSS

SEQ ID NO: 8573 - protein, 125 aa, Artificial Sequence
  Description of Artificial Sequence: Synthetic polypeptide
EVQLVESGGGLVQPGGSLRLSCAASGFTLDGYAIGWFRQAPGKEREAISCITTAGTIYYADSVKGRVTISRDNAKNTVYLQMNSLKPEDTAVYLCAADGFDTPCVAGTDWGYDYEGQGTQVTVSS

SEQ ID NO: 8574 - protein, 126 aa, Artificial Sequence
  Description of Artificial Sequence: Synthetic polypeptide
EVQLVESGGGLVQAGGSLRLSCAASGGTLYDYAIGWFRQAPGKEREGVAYLGASDGATYYADSVKGRFTISSDNAKNTVYLQMNSLKPEDTAVYYCAAAAQWATIRWIQEYDYDTWGQGTQVTVSS

SEQ ID NO: 8575 - protein, 122 aa, Artificial Sequence
  Description of Artificial Sequence: Synthetic polypeptide
EVQLVESGGGLVQAGGSLRLSCTTSGSIFSLSGMGWFRQAPGKQREPVAVITSGGATNYAPYAKGRFTISRDNAKNTVYLQMNSLKPGDTAVYYCALDSPDRSLGAPPFDYWGQGTQVTVSS

SEQ ID NO: 8576 - protein, 126 aa, Artificial Sequence
  Description of Artificial Sequence: Synthetic polypeptide
EVQLVESGGGLVQPGGSLTLSCVASGFTLDGYAIGWFRQAPGKEVESVSCITGRHGTIYYADSVMGRFTISRDNAKSTVYLQMNSLKPEDTAVYYCAADGFDTPCVAGTDWQYDYWGQGTQVTVSS

SEQ ID NO: 8577 - protein, 125 aa, Artificial Sequence
  Description of Artificial Sequence: Synthetic polypeptide
EVQLVESGGGLVQPGGSLRLSCAASGFTLDGYAIGWFRQAPGKEREAISCITTAGTIYYADSVKGRVTISRDNTKNMVYLQMNSLKPEDTAVYLCAADGFDTPCVAGTDWGYDYEGQGTQVTVSS

SEQ ID NO: 8578 - protein, 121 aa, Artificial Sequence
  Description of Artificial Sequence: Synthetic polypeptide
EVQLVESGGGLVQPGGSLRLSCAASGSILDDANAMGWYRQTPGTERALVALITDSGATRYADSVKGRFTISRDNAKNTATLQMNSLKPEDTAVYYCNFREFGGWGTNIDHWGQGTQVTVSS

SEQ ID NO: 8579 - protein, 126 aa, Artificial Sequence
  Description of Artificial Sequence: Synthetic polypeptide
EVQLVESGGGLVQAGGSLRLSCAVSGATFDDYAIGWFRQAPGKEREGVSYIGCNDGSTYYAGSVKGRFTISCDYAKNTVYLQMNSLKPEDTAVYYCAAAAQWATIRWIHEYDYDTWGQGTQVITSS

SEQ ID NO: 8580 - protein, 123 aa, Artificial Sequence
  Description of Artificial Sequence: Synthetic polypeptide
EVQLVESGGGLVQAGGSLRLSCRASGNTGNVNAMGWYRQAPGKQRELVAAVSGGGKTNYADSVKGRFTISIDNAKIIAYLQMNSLKPEDTAVYYCNAGVMGTSGSYYPGDDNWGQGTQVTVSS

SEQ ID NO: 8581 - protein, 123 aa, Artificial Sequence
  Description of Artificial Sequence: Synthetic polypeptide
EVQLVESGGGLVQAGGSLRLSCRASGNTGNVNAMGWYRQAPGKQRELVAAVSGRGKTNYADSVKGRFTISIDNAKIIVYLQMNNLKPEDTAVYYCNAGVMGTSGSYYLGEDNWGQGTQVTVSS

SEQ ID NO: 8582 - protein, 123 aa, Artificial Sequence
  Description of Artificial Sequence: Synthetic polypeptide
EVQLVESGGGLVQAGGSLRLSCAASGNTGNVNAMGWYRQAPGKQRELVAGISSRGTTNYADSVKGRFTISLDSAKITAHLQMNRLKPEDTAVYYCNAGVMGSSGSYYPGEENWGQGTQVTVSS

SEQ ID NO: 8583 - protein, 119 aa, Artificial Sequence
  Description of Artificial Sequence: Synthetic polypeptide
EVQLVESGGGLVQPGGSLRLSCETSRHTLDHYAIAWFRQAPGKEGEGIACVSTSTYYADSVKGRFSISRGNAKNTVYLQMNDLKPEDTAVYHCATTGSGYCTLRAFASWGQGTQVIVSS

SEQ ID NO: 8584 - protein, 123 aa, Artificial Sequence; identical to SEQ ID NO: 8494
  Description of Artificial Sequence: Synthetic polypeptide

SEQ ID NO: 8585 - protein, 126 aa, Artificial Sequence
  Description of Artificial Sequence: Synthetic polypeptide
EVQLVESGGGLVQAGGSLRLSCAVSGGTFDDYAIGWFRQAPGKEREGVSYIGCNDGSTYNAGSVKGRFTISCDYAKNTVYLQMNNLKPEDTAVYYCAAAAQWATIRWIQEYDYDYWGQGTQVTVSS

SEQ ID NO: 8586 - protein, 128 aa, Artificial Sequence
  Description of Artificial Sequence: Synthetic polypeptide
EVQLVESGGGLVQPGGSLRLSCAVSGFPLGYYAIGWFRQAPGKEREEVSCIVTSDGSTYYTDSVKGRFTISRDNAKNTVYLQMNNLNPEDTAVYYCAAGGTIVAVTDSCFIDYVMDYWGKGTLVTVSS

SEQ ID NO: 8587 - protein, 125 aa, Artificial Sequence
  Description of Artificial Sequence: Synthetic polypeptide
EVQLVESGGGLVQPGGSLRLSCAASGFTLDGYAIGWFRQTPGKEREAISCITTAGTIYYADSVKGRVTISRDNAKNTVYLQMNSLKPEDTAVYLCAADGFDTPCVAGTDWGYDYEGQGTQVTVSS

SEQ ID NO: 8588 - protein, 126 aa, Artificial Sequence
  Description of Artificial Sequence: Synthetic polypeptide
EVQLVESGGGSVQAGASLRLSCAASGRTFSGIDMAWYRQAPGNGRELVAVITSGGSTKYVDSVKGRFTIFRDNAKNTVALQMNSLKPEDTAVYYCAAVEESPFYSGTYYPKPGDYWGQGTQVTVSS

SEQ ID NO: 8589 - protein, 125 aa, Artificial Sequence
  Description of Artificial Sequence: Synthetic polypeptide
EVQLVESGGGLVQPGGSLRLSCAASGFTLDGYAIGWFRQAPGKEREAISCITTAGTIYYADSVKGRVTISRDNAKNTVYLQMNSLKPEDTAVYLCAVDGFDTPCVAGTDWGYDYEGQGTQVTVSS

SEQ ID NO: 8590 - protein, 120 aa, Artificial Sequence
  Description of Artificial Sequence: Synthetic polypeptide
EVQLVESGGGLVQPGGSLRLSCAASGNIVSIDAAGWFRQAPGKQREPVATILTGGATNYADSVKGRFTISRDNAKNTVYLQMSSLKPEDTAVYYCYAPMIYYGGRYSDYWGQGTQVTVSS

SEQ ID NO: 8591 - protein, 120 aa, Artificial Sequence
  Description of Artificial Sequence: Synthetic polypeptide
EVQLVESGGGLVQPGGSLRLSCAASGNIASIDAAGWFRQAPGKQREPVATILTGGATNYADSVKGRFTISRDNAKNTVYLQMNSLKPEDTAVYYCYAPMIYYGGRYSDYWGQGTQVTVSS

SEQ ID NO: 8592 - protein, 120 aa, Artificial Sequence
  Description of Artificial Sequence: Synthetic polypeptide
EVQLVESGGGLVQPGGSLRLSCAASGNIVSIDAAGWFRQAPGKQREPVATILTGGATNYADSVKGRFTISRDNAKNTVYLQMNSLKPEDTAVYYCYAPMIAYGGRYSDYWGQGTQVTVSS

SEQ ID NO: 8593 - protein, 120 aa, Artificial Sequence
  Description of Artificial Sequence: Synthetic polypeptide
EVQLVESGGGLVQPGGSLRLSCAASGNIVSIDAAGWFRQAPGKQREPVATILTGGATNYADSVKGRFTISRDNAENTVYLQMNSLKPEDTAVYYCYAPMIYYGGAYSDYWGQGTQVTVSS

SEQ ID NO: 8594 - protein, 120 aa, Artificial Sequence
  Description of Artificial Sequence: Synthetic polypeptide
EVQLVESGGGLVQAGGSLRLSCAASGNAFSIDAAAWYRQAPGKQREPVATILTGGSTNYADSVKGRFTISRDNAKNTVYLQMNSLKPEDTAVYYCYVPMVYYSGRYSDYWGQGTQVTVSS

SEQ ID NO: 8595 - protein, 120 aa, Artificial Sequence
  Description of Artificial Sequence: Synthetic polypeptide
EVQLVESGGGLVQPGGSLRLSCAASGNIVSIDAAGWFRQAPGKQREPVATILTGGATNYADSVKGRFTISRDNAKNTVYLQMNSLKPEDTAVYYCYAPMIYYGGRASDYWGQGTQVTVSS

SEQ ID NO: 8596 - protein, 120 aa, Artificial Sequence
  Description of Artificial Sequence: Synthetic polypeptide
EVQLVESGGGLVQPGGSLRLSCAASGNIVSIDAAGWFRQAPGKQREPVATILTGGATNYADSVKGRFTISRDNAKNTVYLQMNSLKPEDTAVYYCYAPMIYYGGRYSDAWGQGTQVTVSS

SEQ ID NO: 8597 - protein, 119 aa, Artificial Sequence
  Description of Artificial Sequence: Synthetic polypeptide
EVQLVESGGGLVQAGGSLRLSCAASGNAFSIDAAAWYRAPGKQREPVATILTGGSTNYADSVKGRFTISRDNAKNTVYLQMNSLKPEDTAVYYCYVPMVYYSGRYSDYWGQGTQVTVSS

SEQ ID NO: 8598 - protein, 120 aa, Artificial Sequence
  Description of Artificial Sequence: Synthetic polypeptide
EVQLVESGGGLVQAGGSLRLSCAASGNAFSIDAAAWYRQAPGKQREPVATILTGGSTNYADSVKGRFTISRDNAKNLVYLQMNSLKPEDTAVYYCYVPMVYYSGRYSDYWGQGTQVTVSS

SEQ ID NO: 8599 - protein, 120 aa, Artificial Sequence
  Description of Artificial Sequence: Synthetic polypeptide
EVQLVESGGGSLQAGGSLRLSCAASGNIVSIDAAGWFRQAPGKQREPVATILTGGATNYADSVKGRFTISRDNAKNTVYLQMNSLKPEDTAVYYCYAPMIYYGGRYSDYWGQGTQVTVSS

SEQ ID NO: 8600 - protein, 120 aa, Artificial Sequence
  Description of Artificial Sequence: Synthetic polypeptide
EVQLVESGGGLVQPGGSLRLSCAASGNIVSIDAAGWFRQAPGKQREPVATILTGGATNYADSVKGRFTISRDNAENTVYLQMNSLKPEDTAVYYCYAPMIYYGGRYSDYWGQGTQVTVSS

SEQ ID NO: 8601 - protein, 120 aa, Artificial Sequence
  Description of Artificial Sequence: Synthetic polypeptide
EVQLVESGGGLVQPGGSLRLSCAASGNIVSIDAAGWFRQAPGKQREPVATILTGGAANYADSVKGRFTISRDNAKNTVYLQMNSLKPEDTAVYYCYAPMIYYGGRYSDYWGQGTQVTVSS

SEQ ID NO: 8602 - protein, 119 aa, Artificial Sequence
  Description of Artificial Sequence: Synthetic polypeptide
EVQLVESGGGLVQPGGSLRLSCAASGNIVSIDAAGWFRQAPGKQREPVATILTGGATNYADSVKGRFTISRDNAKNTVYLQMNSLKPEDTAVYYCYAPMIYYGGRYFDYWGQGTVTVSS

SEQ ID NO: 8603 - protein, 125 aa, Artificial Sequence
  Description of Artificial Sequence: Synthetic polypeptide
EVQLVESGGGLVQPGGSLRLSCAASGFTLDGYAIGWFRQAPGKEREAISCITTRGTIYYADSVKGRVTISRDNAKNTVYLQMTSLKPEDTAVYLCAADGFDTPCVAGTDWGYDYEGQGTQVTVSS

SEQ ID NO: 8604 - protein, 126 aa, Artificial Sequence
  Description of Artificial Sequence: Synthetic polypeptide
EVQLVESGGGLVQAGGSLRLSCAVSGGTFDDYAIGWFPQAPGKEREGVSYIGCNDGSTYYADSVKGRFTISCDYPKNTVYLQMNHLKPEDTAAYYCAAAAQWATIRWIQQYHYDYWGQGTQVTVSS

SEQ ID NO: 8605 - protein, 122 aa, Artificial Sequence
  Description of Artificial Sequence: Synthetic polypeptide
EVQLVESGGGLVQAGGSLRLSCETSGNTVDDYAMGWFRQAPGKEGEVVACISTSGYTDYADSGKGRFSISIDSNMTLHLHMKRLKHADADLCYSTASVMCSSGTYYPGEENWREGTPVTVSS

SEQ ID NO: 8606 - protein, 126 aa, Artificial Sequence
  Description of Artificial Sequence: Synthetic polypeptide
EVQLVESGGGLVQAGGSLRLSCAVSGGTFDDYAIGWFRQAPGKEREGVSYIGCNDGSTYHADSVKGRFTISCDYAKNTVYLQMNNLKPEDTAVYYCAAAAQWATIRWIQEYYYDYWGQGTQVTVSS

SEQ ID NO: 8607 - protein, 117 aa, Artificial Sequence
  Description of Artificial Sequence: Synthetic polypeptide
AISSGDGFGRTLGGSLRLSCETSRHTLDHYAIGWFRQAPGKDNEGVACITTSTYYADSVKGPFSISRDNAKNTVYLQMNSLKPEDTAVYYCATTGSGYCTLRAFASWGQGTQVIVSS

SEQ ID NO: 8608 - protein, 126 aa, Artificial Sequence
  Description of Artificial Sequence: Synthetic polypeptide
EVQLVESGGGLVQPGGSLTLSCVASGFTLDGYAIGWFRQAPGKEVESVSCITGRHGTIYYADSVMGRFTISRDNAKNTVYLQMNSLKPEDTAVYYCAADGFDTPCVAGTDWQYDYWGQGTQVTVSS

SEQ ID NO: 8609 - protein, 127 aa, Artificial Sequence
  Description of Artificial Sequence: Synthetic polypeptide
EVQLVESGGGLVQPGGSLRLSCAVSGFPLGYYAIGWFRQAPGKEREEVSCIVTSDGSTYYTDSVKGRFTISRDAAKNTVYLQMNNLNPEDTAVYYCAAGGTLVAVTDCFIDYVMDYWGKGTLVTVSS

SEQ ID NO: 8610 - protein, 119 aa, Artificial Sequence
  Description of Artificial Sequence: Synthetic polypeptide
RWQLVESGGGLVQPGGSLRLSCETSRHTLDHYAIGWFRQAPGKGGEGVACISTNTYYADSVKGRFSISRDNAKNTVYLQMNDLKPEDTAVYHCATTGSGYCTLRAFASWGQGTQVTVSS

SEQ ID NO: 8611 - protein, 125 aa, Artificial Sequence
  Description of Artificial Sequence: Synthetic polypeptide
EVQLVESGGGLVQPGGSLRLSCAASGFTLDGYAIGWFRQAPGKEREAISCITTAGTIYYADSVKGRVTISRDNAKNTVYLQMNSLKPEDTAVYLCAADGFDTPCVAGTDWGYDYGGQGTQVTVSS

SEQ ID NO: 8612 - protein, 126 aa, Artificial Sequence
  Description of Artificial Sequence: Synthetic polypeptide
EVQLVESGGGLVQPGGSLRLSCAASGFGLDYYAIGWFRQAPGKEREGVSCIDSSDGSTYYVDSAKGRFTISRDNAKNTVYLQMNNLKPEDTAVYYCAAHALICGSYWSNGVVFDTWGQGTQVTVSS

SEQ ID NO: 8613 - protein, 126 aa, Artificial Sequence
  Description of Artificial Sequence: Synthetic polypeptide
EVQLVESGGGLVQAGGSLRLSCAASGFTFDDYAIGWFRQAPGKEREGVSYIGCNDGSTYIADSVKGRFTISCDYAENTVYLQMDSLKSEDTAVYYCAAAAQWATIRWIQEYDYDYWGQGTQVTVSS

SEQ ID NO: 8614 - protein, 138 aa, Artificial Sequence
  Description of Artificial Sequence: Synthetic polypeptide
EVQLVESGGGLVQAGGSLRLSCATSGFRFDDYDIGWFRQAPGKEREGVSCISRGDGMTYYADFVKGRFTISSDSAKNTVYLQMNSLKPEDTAVYYCAADPGRSVGWVRAWSSTAQTMGVPSPADFASRGQGTQVTVSS

SEQ ID NO: 8615 - protein, 120 aa, Artificial Sequence
  Description of Artificial Sequence: Synthetic polypeptide
EVQLVESGGGLVQPGGSLRLSCAASQFTLESYAIGWFRQAPGKDSEGVACISSSTYYADSVKGRFTISRDNAKNTVYLQMESLKPEDTAVYHCATSGAGSYCTLRAFGSWGQGTQVTVSS

SEQ ID NO: 8616 - protein, 120 aa, Artificial Sequence
  Description of Artificial Sequence: Synthetic polypeptide
EVQLVESGGGLVQPGGSLRLSCAASGFTLDNYAIGWFRQVPGKEREGVSCISSSDGKTYYADSVKGRFTISRDNAKNTVYLQMNSLKPEDTAVYYCARETRCLGSRWMGGGQGTQVTVSS

SEQ ID NO: 8617 - protein, 125 aa, Artificial Sequence
  Description of Artificial Sequence: Synthetic polypeptide
EVQLVESGGSLVQPGGSLRLSCAASGFTLDGYAIGWFRQAPGKEREAISCITTRGTIYYADSVKGRVTISRDNAKNTVYLQMTSLKPEDTAVYLCAADGFDTPCVAGTDWGYDYEGQGTQVTVSS

SEQ ID NO: 8618 - protein, 128 aa, Artificial Sequence
  Description of Artificial Sequence: Synthetic polypeptide
EVQLVESGGGLVQPGGSLRLSCAVSGFPLGYYAIGWFRQAPGKEREEVSCIVTSDGSTYYTNSVKGRFTISRDNAKNTVYLQMNNLNPEDTAVYYCAAGGTIVAVTDSCFIDYVMDYWGKGTLVTVSS

SEQ ID NO: 8619 - protein, 125 aa, Artificial Sequence
  Description of Artificial Sequence: Synthetic polypeptide
EVQLVESGGSLVQPGGSLRLSCAASGFTLDGYAIGWERQAPGKEREAISCITTRGTIYYADSVKGRVTISRDNAKNTVYLQMTSLKPEDTAVYLCAADGFDTPCVAGTDWGYDYEGQGTQVTVSS

SEQ ID NO: 8620 - protein, 126 aa, Artificial Sequence
  Description of Artificial Sequence: Synthetic polypeptide
EVQLVESGGGLVQPGGSLRLSCAASGATFDDYAIGWFRQAPGKEREGVSYIGCNDGATYYSGSVKGRFTISCDYAKNTVYLQMNSLKPEDTAVYYCAAAAQWATIRWIHEYDYNIWGQGTQVTVSS

SEQ ID NO: 8621 - protein, 123 aa, Artificial Sequence
  Description of Artificial Sequence: Synthetic polypeptide
EVQLVESGGGLVQAGGSLRLSCRASGNTGNVNAMGWYRQAPGKQRELVAAVSGGGKTNYADFVKGRFTISIDNAKIIVYLQMNNLKPEDTAVYYCNAGVMGTSGSYYLGEDNWGQGTQVTVSS

SEQ ID NO: 8622 - protein, 124 aa, Artificial Sequence
  Description of Artificial Sequence: Synthetic polypeptide
EVQLVESGGGLVQAGGSLRLSCAASGFTFDDYGIAWFRQAPGKEREGLACITRSGYTTYYLDSVRGRFTISSDNAKNTVYLQMNSLNPEDTAVYYCAADEPLVVWNCNGDFGSWGQGTQVTVSS

SEQ ID NO: 8623 - protein, 126 aa, Artificial Sequence
  Description of Artificial Sequence: Synthetic polypeptide
EVQLVESGGGLVQAGGSLRLSCAVSGGTFDDYAIGWFRQAPGKEREGVSYIGCNDGSTYNAGSVKGRFTISCDYAKNTVYLQMNNLNSEDTAVYYCAAAAQWATIRWIQEYDYDYWGQGTQVTVSS

SEQ ID NO: 8624 - protein, 126 aa, Artificial Sequence
  Description of Artificial Sequence: Synthetic polypeptide
EVQLVESGGGLVQAGGSLRLSCAAFGFTFDDYAIGWFRQAPGKEREGVSYIGCNDYSTYYSDSVKGRFTISCDYAKNTVYLQMNNLKPEDTAVYYCAAAAQWATIRWIHEYDYNYWGQGTQVTVSS

SEQ ID NO: 8625 - protein, 124 aa, Artificial Sequence
  Description of Artificial Sequence: Synthetic polypeptide
EVQLVESGGGLVQAGGSLRLSCATSGFTFDDYGIAWFRQAPGKEREGLACITRSGYTTYYLDSVKGRFTISSDNAKNTVYLQMNSLNPEDTGVYYCAADEPLIVWNCNGDFGSWGQGTQVTVSS

SEQ ID NO: 8626 - protein, 126 aa, Artificial Sequence
  Description of Artificial Sequence: Synthetic polypeptide
EVQLVESGGGLVQAGGSLRLSCAVSGATFDDYAIGWFRQAPGKEREGVSYIGCNDGSTYYAGSVKGRFTISCDYAKNTVYLQMNSLKPEDTAVYYCAAAAQWATIRWIQEYDYDTWGQGTQVTVSS

SEQ ID NO: 8627 - protein, 119 aa, Artificial Sequence
  Description of Artificial Sequence: Synthetic polypeptide
EVQLVESGGGLVQPGGSLRLSCETSRHTLDHYAIGWFRQAPGKEGEGVACISTSTYYADSVKGRESISRDNAKNTVYLQMNSLKPEDTAVYYCATTGSGLCTLRAFASWGQGTQVITSS

SEQ ID NO: 8628 - protein, 120 aa, Artificial Sequence
  Description of Artificial Sequence: Synthetic polypeptide
EVQLVESGGGLVQPGGSLRLSCAASQSTLESYAIGWFRQAPGKDSEGVACISSSTYYADSVKGRFTISRDNAKNTVYLQMESLKPEDTAVYHCATSGAGSYCTLRAFGSWGQGTQVTVSS

SEQ ID NO: 8629 - protein, 126 aa, Artificial Sequence
  Description of Artificial Sequence: Synthetic polypeptide
EVQLVESGGGLVQAGGSLRLSCAVSGGTFDDYAIAWFRQAPGKEREGVSYIGCNDGSTYYAGSVKGRFTISCDNAKNTVYLQMNSLKPDDTAVYYCAAAAQWATIRWIQEYDYDYWGQGTQVTVSS

SEQ ID NO: 8630 - protein, 126 aa, Artificial Sequence
  Description of Artificial Sequence: Synthetic polypeptide
EVQLVESGGGLVQAGGSLRLSCAVSGATFDDYAIGWFRQAPGKEREGVSYIGCNDGSIYYAGSVKGRFTISCDYAKNTVYLQMNSLKPEDTAVYYCAAAAQWATIRWIQEYDYDTWGQGSQVTVSS

SEQ ID NO: 8631 - protein, 119 aa, Artificial Sequence
  Description of Artificial Sequence: Synthetic polypeptide
EVQLVESGGGLVQPGGSLRLSCETSRHTLDHYAIGWFRQAPGKENEGVACISTSTYYADSVKGRFSISRDNAKNTVYLQMNSLKPEDTAVYYCATTGSGYCTLRAFASWGQGTQVTVSS

SEQ ID NO: 8632 - protein, 125 aa, Artificial Sequence
  Description of Artificial Sequence: Synthetic polypeptide
EVQLVESGGGLVQPGGSLRLSCTASGFQLVYHDLGWFRQVPGKEREGISCISSTDGSTYYTDSVKGRFTISRDNAKNIVYLQMNSLKSEDTAVYYCAADWRNVCRLPLGTGFGSWGQGTQVTVSS

SEQ ID NO: 8633 - protein, 125 aa, Artificial Sequence
  Description of Artificial Sequence: Synthetic polypeptide
EVQLVESGGGLVQAGGSLTLSCEASGTIFSINGQGWFRQAPGKQREPVAFITSGGMTNYADHVKGRFPISRDNAKNTVYLQMNSLKPEDTAVYYCAAEDSPPNYRCSGEWCFDYWGQGTQVTVSS

SEQ ID NO: 8634 - protein, 125 aa, Artificial Sequence
  Description of Artificial Sequence: Synthetic polypeptide
EVQLVESGGGLVQAGGSLRLSCAASGFTLDGYAIGWFRQAPGKEREAISCITTAGTINYADSVKGRVTISRDNAKNTVYLQMNSLKPEDTAVYLCAADGFDTPCVAGTDWGYDYEGQGTQVTVSS

SEQ ID NO: 8635 - protein, 125 aa, Artificial Sequence
  Description of Artificial Sequence: Synthetic polypeptide
EVQLVESGGGLVQLGGSLRLSCAASGFTLDGYAIGWFRQAPGKEREAISCITTAGTIYYADSVKGRVTISRDNAKNTVYLQMNSLKPEDTAVYLCAADGFDTPCVAGTDWGYDYEGQGTQVTVSS

SEQ ID NO: 8636 - protein, 125 aa, Artificial Sequence
  Description of Artificial Sequence: Synthetic polypeptide
EVQLVESGGGLVQPGGSLRLSCAASGFTLDGYAIGWFRQAPGKEREAISCITTRGTIYYADSVKGRVTISRDNAKNTVYLQMNSLKPEDTAVYLCAADGFDTPCVAGTDWGYDYEGQGTQVTVSS

SEQ ID NO: 8637 - protein, 120 aa, Artificial Sequence
  Description of Artificial Sequence: Synthetic polypeptide
EVQLVESGGGLVQAGGSLRLSCTASINAVSIDAAGWFRQAPGMQREPVATILTSGSSTYADSVKGRFTISRDSAKNTVYLQMNSLKPEDTAVYTCYAPMVYYSGSYSDYWGQGTQVTVSS

SEQ ID NO: 8638 - protein, 124 aa, Artificial Sequence
  Description of Artificial Sequence: Synthetic polypeptide
EVQLVESGGGLVQAGGSLRLSCAASGIIFGSKGMGWYRQAPGKQRELVATVTSGGDIKYADSVKGRFSISRDNAKNTVYLQMNSLKPEDTAVYYCAALFPLYGTGELTPLDDYWGQGTQVTVSS

SEQ ID NO: 8639 - protein, 120 aa, Artificial Sequence
  Description of Artificial Sequence: Synthetic polypeptide
EVQLVESGGGLVQAGGSLRLSCVASGIIFSDSGMGWFRQAPGKQREPVAVITRGGSTNYADSVKGRFTISRDNAKNTVYLQMNNLKPEDTAVYAADTFDRHLQAPPFDYWGQGTQVTVSS

SEQ ID NO: 8640 - protein, 120 aa, Artificial Sequence
  Description of Artificial Sequence: Synthetic polypeptide
EVQLVESGGGLVQPGGSLRLSCAAPKIFSTAPMNWFRQAPGKQRELVAGISSGGSTMYADSVKGRFTISRDSAKNTLDLQMNSLKPEDTAVYYCNAEWAPLGPRSRVDYWGQGTQVTVSS

SEQ ID NO: 8641 - protein, 121 aa, Artificial Sequence
  Description of Artificial Sequence: Synthetic polypeptide
EVQLVESGGGWVQPGGSLGLSCTAGRSAFSINDMGWYRQPPGKQREVVAIITFDGSANYADSVKGRFTISRRNYNNTVYLQMNNLKPEDTAVYYCNADAAASPRGGYNEYWGQGTQVTVSS

SEQ ID NO: 8642 - protein, 116 aa, Artificial Sequence
  Description of Artificial Sequence: Synthetic polypeptide
EVQLVESGGGLVQAGGSLRLSCTASESSFSLTSMGWYRQAPGKQREAVASIDGDGTTSYADSVKGRFTISRDNAKNTVNLQMNSLKPEDTAVYFCFARKWILDIYWGQGTQVTVSS

SEQ ID NO: 8643 - protein, 125 aa, Artificial Sequence
  Description of Artificial Sequence: Synthetic polypeptide
EVQLVESGGGLVQPGGSLRLSCAASGFTLDTYAIGWFRQAPGKEREGVSCISKIDEQRYYLDSVKGRFTISRDNAKNTVYLQMNSLKPEDTAVYYCATPRSQYYCHNGAIGYDRWGQGTQVTVSS

SEQ ID NO: 8644 - protein, 129 aa, Artificial Sequence
  Description of Artificial Sequence: Synthetic polypeptide
EVQLVESGGGLVQSGGSLRLSCAASGFTLDYYTVGWFRQAPGKEREGVSCINSSDGRTLYADSVKGRFTISRDNAKNTVYLQMNSLKPEDTAVYYCAAEKPGLTSYYYPCPPPGEYDYSGQGTQVTVSS

SEQ ID NO: 8645 - protein, 125 aa, Artificial Sequence
  Description of Artificial Sequence: Synthetic polypeptide
EVQLVESGGGLVQTGGSLRLSCAASGGTLSSYAMGWFRQAPGKEREFVAAITWSGTRTLYADSVKGRFTISRDNANNTVYLQMNSLEPEDTAVYYCAAHRHPYALVVDHKAFDYWGQGTQVTVSS

SEQ ID NO: 8646 - protein, 126 aa, Artificial Sequence
  Description of Artificial Sequence: Synthetic polypeptide
EVQLVESGGGSVQAGGSLRLSCAASGSIFNINAMGWYRQARGKGRELVAVVTNGGTTTYTGSVKGRFTISRDNAKNTVYLQMNSLKLEDTAVYYCAGVEESPFHSGTYYPLPGDYWGQGTQVTVSS

SEQ ID NO: 8647 - protein, 127 aa, Artificial Sequence
  Description of Artificial Sequence: Synthetic polypeptide
EVQLVESGGGLVQAGGSLRLSCAASGRTFGTYAMAWFRQAAGKEREFVGAISSWGGGRTYYPPSVQGRFTISRENAKNTVYLQLSSLKPEDTAVYYCAAKRDNCSAFGCYAGPYDYWGQGTQVTVSS

SEQ ID NO: 8648 - protein, 130 aa, Artificial Sequence
  Description of Artificial Sequence: Synthetic polypeptide
EVQLVESGGGLVQAGGSLRLSCAASGFTFDDYAIGWFRQAPGKEREGVLCFTRSRGSTDGSTYYADSVKGRFTISSDNAKNTVYLQMNSLKPEDTAVYYCATDHYLRVGLKCRDYEYDYWGQGTQVTVSS

SEQ ID NO: 8649 - protein, 121 aa, Artificial Sequence
  Description of Artificial Sequence: Synthetic polypeptide
EVQLVESGGGLVQPGGSLRLSCIASGFTLDYYAMGWFRQAPGKEREGVACISSTDRSTYYPDSVKGRFTISRDNAENTVYLQMNSLKPEDTAVYSCAVGWNPDCENGMDYWGKGTLVTVSS

SEQ ID NO: 8650 - protein, 118 aa, Artificial Sequence
  Description of Artificial Sequence: Synthetic polypeptide
EVQLVESGGGLVQTGGSLRLSCVASGNIYSLTSTGWYRQAPGQQREWIATIRGDDSTEYANSVKGRFTISRENALKTVYLQMNSLKPEDTAIYYCAARTLPLGQPNYWGQGTQVTVSS

SEQ ID NO: 8651 - protein, 123 aa, Artificial Sequence
  Description of Artificial Sequence: Synthetic polypeptide
EVQLVESGGGLVQSGGSLRLSGAASGFTLDSYAIGWFRQAPGKEREGVSCISNSDGRTYYADSVKGRFTISRDSAENTVYLQMNSLKPEDTAVYLCATEGHCHGTNWTRPHSVSQGTQVTVSS

SEQ ID NO: 8652 - protein, 119 aa, Artificial Sequence
  Description of Artificial Sequence: Synthetic polypeptide
EVQLVESGGGLVQPGGSLRLSCETSRHTLDHYAIGWFRQAPGKENEGVACISTSTYYADSVKGRFSISRDNVKNTVYLQMNSLKPEDTAVYYCATTGSGYCTLRAFASWGQGTQVTVSS

SEQ ID NO: 8653 - protein, 129 aa, Artificial Sequence
  Description of Artificial Sequence: Synthetic polypeptide
EVQLVESGGGLVQPGGSLRLSCTASGRSISSSAMGWFRQAPGKEREFVASVHWTDVSTWYADSVKGRFTISRDNAKNTVYLQMNSVKPEDTAVYHCAASRAFSPDSWRRYSDSDSYESWGQGTQVTVSS

SEQ ID NO: 8654 - protein, 118 aa, Artificial Sequence
  Description of Artificial Sequence: Synthetic polypeptide
EVQLVESGGGLVQAGGSLRLSCAASGSISSLNTMAWYRQTPGQQREWVARITGAGSTTYADSVKGRFTISRDDALYITYLQMTSLKPEDTAVYYCAARTLPLGADNWWGQGTQVTVSS

SEQ ID NO: 8655 - protein, 127 aa, Artificial Sequence
  Description of Artificial Sequence: Synthetic polypeptide
EVQLVESGGGLVQPGGSLRLSCAASGFTLDDYTTGWFRQAPGKEREGVSCISSSDGGTWYADSVKGRFTISRDNAKNTVYLQMNSLKPEDAAVYYCAVDSTAGSSCPGPDFYAMDYWGKGTLVTVSS

SEQ ID NO: 8656 - protein, 120 aa, Artificial Sequence; identical to SEQ ID NO: 8615
  Description of Artificial Sequence: Synthetic polypeptide

SEQ ID NO: 8657 - protein, 121 aa, Artificial Sequence
  Description of Artificial Sequence: Synthetic polypeptide
EVQLVESGGGLVQAGESLRLSCVASERAFGMNYMGWFRQSAGKQREQVAAISQSGDTNYADSVKGRFTISRDNAKNTLYLEMNSLRPEDTAVYYCYAGPSIGLVISGLGYWGQGTQVTVSS

SEQ ID NO: 8658 - protein, 126 aa, Artificial Sequence
  Description of Artificial Sequence: Synthetic polypeptide
EVQLVESGGGLVQTGGSLRLSCVASGGTLDDYAIGWFRQAPGKEREGVSYIGSNDGSTYYAGAVKGRFTISSDHAKNTVYLQMNSLKPEDTAVYYCAAAAQWGTIRWIHEYDYEYWGQGTQVTVSS

SEQ ID NO: 8659 - protein, 126 aa, Artificial Sequence
  Description of Artificial Sequence: Synthetic polypeptide
EVQLVESGGGLVQPGGSLRLSCAASGFTLENYAIAWFRQAPGKEREGVSCISSKDSNTYYADSVKGRFTISRDNAKNTVYLQMNSLPEDTAVYYCAADRLFSCAIIGWDDPPFGSWGQGTQVTVSS

SEQ ID NO: 8660 - protein, 118 aa, Artificial Sequence
  Description of Artificial Sequence: Synthetic polypeptide
EVQLVESGGGLVQAGGSLRLSCAASGSIFSINAMAWYRQAPGKQREWVARITGDGTTNYADSVKGRFTISRDNAKSTMYLQMNSLKPEDTAVYYCAARALPLGTDNYWGQGTQVTVSS

SEQ ID NO: 8661 - protein, 123 aa, Artificial Sequence
  Description of Artificial Sequence: Synthetic polypeptide
EVQLVESGGGLVQAGGSLRLSCAASGRTFSRYAMGWFRRAPGKEREFVATISASGMSTYYKDSVKGRFTISRDNAQNTTWLQMNSLKPEDTAVYYCAAADDFLPRLPSSYTYWGQGTQVTVSS

SEQ ID NO: 8662 - protein, 122 aa, Artificial Sequence
  Description of Artificial Sequence: Synthetic polypeptide
EVQLVESGGGLVQAGGSLRLSCVASGSTSSINAMGWYRQTPGKQREFLAVIENIGNTRYADSVLGRFTISRDNAKNTVYLQMNSLKPEDTAVYYCNANARTTPTSISTAWFWGQGTQVTVSS

SEQ ID NO: 8663 - protein, 119 aa, Artificial Sequence
  Description of Artificial Sequence: Synthetic polypeptide
EVQLVESGGGLVQPGGSLRLSCETSRHTLDHYAIGWFRQAPGKEGEGVACISTNTYYADSVKGRFSISRDNAKNTVYLQMNDLKPEDTAVYHCATTGSGYCTLRAFASWGQGTQVTVSS

SEQ ID NO: 8664 - protein, 125 aa, Artificial Sequence
  Description of Artificial Sequence: Synthetic polypeptide
EVQLVESGGGLVQAGGSLRLSCAASGFTFDDYDIGWFRQAPGKEREAVSRISNRDGSTYYLDSVRGRFTASSDNAKNAVYLQMNNLKPEDTAVYYCAATTALVGMLLPAYEYDYWGQGTQVTVSS

SEQ ID NO: 8665 - protein, 128 aa, Artificial Sequence
  Description of Artificial Sequence: Synthetic polypeptide
EVQLVESGGGLVQPGGSMRPSCTGSGFTLDDYAIGWFRQAPGKEREGVSCISSTDSRTYYPDSVEGRFTISRDNAKNTVYLQMNSLKPEDTAVYYCATDVLECNYPGGTYYPLAFGSWGQGTQVTVSS

SEQ ID NO: 8666 - protein, 127 aa, Artificial Sequence
  Description of Artificial Sequence: Synthetic polypeptide
EVQLVESGGGLVQAGGSLRLSCAASGRTFSSCAMGWFRQAPGKEREIVAAISWRGGSTWYADSVKGRFTISRDNAKNTVYLQMSNLKPEDTAVYYCAADETSGSYYYTVDIDEYDYWGQGTQVTVSS

SEQ ID NO: 8667 - protein, 116 aa, Artificial Sequence
  Description of Artificial Sequence: Synthetic polypeptide
EVQLVESGGGLVQPGGSLRLSCAASGTAFSITSMGWYRQASGEQRELVARIDSDGSTNYADSVKGRFTISRDNAKNTVYLQMNSLKPEDTAVYYCNAKKWILETYWGQGTQVTVSS

SEQ ID NO: 8668 - protein, 124 aa, Artificial Sequence
  Description of Artificial Sequence: Synthetic polypeptide
LESGGGMVQPGRSLRLSCAVSGFTFDDYAMHWIRQVPGKGLEWVAGISWNSVKVDYADAVRGRFTISRDNAKNSLHLEMSNLRRDDTAFYFCAKDGGPGMTIGGYVVTGRFDPWGQGTLVHVSS

SEQ ID NO: 8669 - protein, 96 aa, Artificial Sequence
  Description of Artificial Sequence: Synthetic polypeptide
DIVLTQSPASLAVSLGQRATISCRASESVDSYGNSFMHWYQQKPGQSPKLLIYVASNLESGVPARFSGSGSRTDFTLTIDPVEADDAATYYCQQNN

SEQ ID NO: 8670 - protein, 120 aa, Artificial Sequence
  Description of Artificial Sequence: Synthetic polypeptide
QVQLQESGPGLVRPSQTLSLTCTVSGFSITSSSYCWHWVRQPPGRGLEWIGRICYEGSIDYSPSIKSRVTMLRDTSKNQFSLRLSSVTAADTAVYYCARENHGTTTSMDYWGQGSLVTVS

SEQ ID NO: 8671 - protein, 91 aa, Artificial Sequence
  Description of Artificial Sequence: Synthetic polypeptide
DIQMTQSPSSLSASVGDRVTITCRASESVDSYGNSFMHWYQQTPGKAPKLLIYVASNLESGVPSRFSGSGSGTDYTFTISSLQPEDIATYT

SEQ ID NO: 8672 - protein, 111 aa, Artificial Sequence
  Description of Artificial Sequence: Synthetic polypeptide
DIQMTQSPSSLSASVGDRVTITCRASESVDSYGNSFMHWYQQTPGKAPKLLIYVASNLESGVPSRFSGSGSGTDFTFTISSLQPEDIATYYCQQNNEDPLTFGQGTKLQIT

SEQ ID NO: 8673 - protein, 137 aa, Artificial Sequence
  Description of Artificial Sequence: Synthetic polypeptide
QSQLQESGPRLVEASETLSLTCNVSGESTGACTYFWGWVRQAPGKGLEWIGSLSHCQSFWGSGWTFHNPSLKSRLTISLDTPKNQVFLKLTSLTAADTATYYCARFDGEVLVYNHWPKPAWVDLWGRGIPVTVTVSS

SEQ ID NO: 8674 - protein, 137 aa, Artificial Sequence
  Description of Artificial Sequence: Synthetic polypeptide
QPQLQESGPGLVEASETLSLTCTVSGDSTAACDYFWGWVRQPPGKGLEWIGGLSHCAGYYNTGWTYHNPSLKSRLTISLDTPKNQVFLKLNSVTAADTAIYYCARFDGEVLVYHDWPKPAWVDLWGRGTLVTVTVSS

SEQ ID NO: 8675 - protein, 129 aa, Artificial Sequence
  Description of Artificial Sequence: Synthetic polypeptide
QVQLQESGPGLVKPSETLSLTCTVSGDSINTGHHYWGWVRQVPGKGPEWIAHIHYNTAVLHNPALKSRVTISIFTLKNLITLSLSNVTAADTAVYFCVRSGGDILYYIEWQKPHWFYPWGPGILVTVSS

SEQ ID NO: 8676 - protein, 134 aa, Artificial Sequence
  Description of Artificial Sequence: Synthetic polypeptide
QLQLQESGPGLVKPSETLSLTCTVSGGSMRGTDWGENDFHYGWIRQSSAKGLEWIGSIHWRGRTTHYKTSFRSRATLSIDTSNNRFSLTFSFVTAADTAVYYCARHKYHDIFRVVPVAGWFDPWGQGLLVTVSS

SEQ ID NO: 8677 - protein, 133 aa, Artificial Sequence
  Description of Artificial Sequence: Synthetic polypeptide
EVHLEESGPGLVRPSETLSLTCTASGGSIRGGEWGDSDYHWGWVRHSPEKGLEWIGSIHWRGTTHYNAPFRGRGRLSIDLSRNQFSLRLTSVTAEDTAVYYCVKHKYHDIVMVVPIAGWFDPWGQGLQVTVSS

SEQ ID NO: 8678 - protein, 141 aa, Artificial Sequence
  Description of Artificial Sequence: Synthetic polypeptide
QVQLVQSGPEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS

SEQ ID NO: 8679 - protein, 141 aa, Artificial Sequence
  Description of Artificial Sequence: Synthetic polypeptide
QVQLVQSGPEVKKPGSSVKVSCKASGNTFSKYDVHWVRQATGQGLEWVGWISHERDKTESAQRFKGRVTFTRDTSATTAYMELRGLTSDDTAIYYCTRGSKHRLRDYVLYDDYGLINYQEWNDYLEFLDVWGHGTAVTVSS

SEQ ID NO: 8680 - protein, 140 aa, Artificial Sequence
  Description of Artificial Sequence: Synthetic polypeptide
QVQLEQSGAEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVS

SEQ ID NO: 8681 - protein, 141 aa, Artificial Sequence
  Description of Artificial Sequence: Synthetic polypeptide
QVQLVQSGAEVKKPGSSVKVSCKASGNTFRKYDVHWVRQATGQGLEWVGWMSHEGDKTESAQRFKGRVSFTRDNSASTAYIELRGLTSDDTAIYYCTGGSKHRLRDYVLYDDYGLINQQEWNDYLEFLDVWGHGTAVTVSS

SEQ ID NO: 8682 - protein, 135 aa, Artificial Sequence
  Description of Artificial Sequence: Synthetic polypeptide
RVQLVESGGGVVQPGKSVRLSCVVSDFPFSKYPMYWVRQAPGKGLEWVAAISGDAWHVVYSNSVQGRFLVSRDNVKNTLYLEMNSLKIEDTAVYRCARMFQESGPPRLDRWSGRNYYYYSGMDVWGQGTTVTVSS

SEQ ID NO: 8683 - protein, 135 aa, Artificial Sequence
  Description of Artificial Sequence: Synthetic polypeptide
RVQLVESGGGVVQPGKSVRLSCVVSDFPFSKYPMYWVRQAPGKGLEWVAAISADAWHVVYSGSVQGRFLVSRDNSKNILYLEMNTLKIEDTAVYRCARMFQESGPPRFDSWSGRNYYYYSGMDVWGQGTTVTVSS

SEQ ID NO: 8684 - protein, 135 aa, Artificial Sequence
  Description of Artificial Sequence: Synthetic polypeptide
QVQLVESGGGVVQPGKSLRLSCVVSNFLFNKRHMHWVRQAPGKGLEWIAVISSDAIHVDYASSVRGRSLISRDNSKNSLYLDMNNLKIEDTATYYCARDRDGYGPPQIQTWSGRYLHLYSGIDAWGLGTTVTVSS

SEQ ID NO: 8685 - protein, 135 aa, Artificial Sequence
  Description of Artificial Sequence: Synthetic polypeptide
QVQLVESGGGVVQPGKSLRLSCVVSNFIFNKYPMYWVRQAPGKGLEWVAAISADAWHVDYAASVKDRFLISRDNSKNALYLEMNTLRVEDTGIYYCARNIEEFSVPQFDSWSGRSYYHYFGMDVWGQGTTVTVSS

SEQ ID NO: 8686 - protein, 135 aa, Artificial Sequence
  Description of Artificial Sequence: Synthetic polypeptide
QVHLVESGGGVVQPGKSLRLSCETSGFIFNEYPMYWIRQAPGKGPEWVAAISADAWHVDYAGSVRGRFTVSRDNSKNSLYLDMKSLKVEDTAIYFCAKDGEEHKVPQLHSWSGRNLYHYTGFDVWGPGTTVTVSS

SEQ ID NO: 8687 - protein, 135 aa, Artificial Sequence
  Description of Artificial Sequence: Synthetic polypeptide
QVHLVESGGGVVQPGKSLRLSCETSGFIFNQYPMYWVRQAPGKGPEWVAAISADAWHVDYPGSVRGRFTVSRDNSKSSLYLDMKSLKVEDTAIYFCAKDGEEHKVPQLHSWSGRNLYHYTGFDVWGPGTTVTVSS

SEQ ID NO: 8688 - protein, 135 aa, Artificial Sequence
  Description of Artificial Sequence: Synthetic polypeptide
EVHLVESGGGVVQPGKSLRLSCVTSGFIFKQYPMYWIRQAPGKGLEWVAAISADAWHVDYAGSVRGRFTVSRDNSKNSLYLDMNSLTVEDTAIYFCAKDGEEHEVPQLHSWSGRNLYHYTGVDIWGPGTTVTVSS

SEQ ID NO: 8689 - protein, 135 aa, Artificial Sequence
  Description of Artificial Sequence: Synthetic polypeptide
EVRLMESGGGVVQPGKSLRLSCVTSGFIFKKYPMYWIRQAPGKGLEWVAAISADAWHVDYPGSVRGRFTVSRDNSKNSLYLDMNSLTVEDTAIYFCAKDGEEHEVPQLHSWSGRNLYHYTGVDVWGPGTTVTVSS

SEQ ID NO: 8690 - protein, 142 aa, Artificial Sequence
  Description of Artificial Sequence: Synthetic polypeptide
MEHLWFFLLLVAAPRWVLSQVQLQESGPGLVKPSETLSLTCTVSGGSISSHYWSWIRQSPGKGLQWIGYIYYSGSTNYSPSLKSRVTISVETSKNQFSLKLTSMTAADTAVYYCARGPVPAVFYGDYRLDPWGQGTLVTVSS

SEQ ID NO: 8691 - protein, 133 aa, Artificial Sequence
  Description of Artificial Sequence: Synthetic polypeptide
MAVQLLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSS

SEQ ID NO: 8692 - protein, 122 aa, Artificial Sequence
  Description of Artificial Sequence: Synthetic polypeptide
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSS

SEQ ID NO: 8693 - protein, 133 aa, Artificial Sequence
  Description of Artificial Sequence: Synthetic polypeptide
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGDALRGRYFDFWGRGTGLRVSTS

SEQ ID NO: 8694 - protein, 132 aa, Artificial Sequence
  Description of Artificial Sequence: Synthetic polypeptide
QVQLVQSGTALKSPGSSAKLSCTVLGDEFGTYFISWIRQAPGQGLEWVGGIVPHSQLQSSAQKFHGRITISAGAGVTPPVVSLQLTNLTFEDTGTYFCARERGRHRDPKTGDALRGRYFDFWGRGTGVRVST

SEQ ID NO: 8695 - protein, 132 aa, Artificial Sequence
  Description of Artificial Sequence: Synthetic polypeptide
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGKAPRGRYFDFWGRGTGVTVSA

SEQ ID NO: 8696 - protein, 129 aa, Artificial Sequence
  Description of Artificial Sequence: Synthetic polypeptide
EVQLSESGGGFVKPGGSLRLSCEASGFTFNNYAMGWVRQAPGKGLEWVSVTSAHGGSAYFGEFVKGRFTMSRDHFIDTVYLEMNRLTVEDTAVYYCVRVTFYHEGSGYYYRAGNYFDSWGQGTLVIVSA

SEQ ID NO: 8697 - protein, 129 aa, Artificial Sequence
  Description of Artificial Sequence: Synthetic polypeptide
EVQLSESGGGVVKPGGSLRLSCEASGFTFSNYAMSWVRQAPGKGLEWVSVTGGHGTYGYYGEFVKGRFTISRDHSMDTVYLQMNRLRVEDTAVYYCVRTPYYHESSGYYYRAGNYFDFWGKGTLVIVSA

SEQ ID NO: 8698 - protein, 129 aa, Artificial Sequence
  Description of Artificial Sequence: Synthetic polypeptide
EVQLSESGGGFVKPGGSLRLSCEASGFTFNNYAMSWVRQAPGKGLEWVSVTSAHGGSAYYGEFVKGRFTMSRDHFIDTVYLEMNRLTVEDTAVYYCVRVTFYHEGSGYYYRAGNYFDSWGKGTRVVVSA

SEQ ID NO: 8699 - protein, 129 aa, Artificial Sequence
  Description of Artificial Sequence: Synthetic polypeptide
EVQLSESGGGFVKPGGSLRLSCEASGFTFNNYAMSWVRQAPGKGLEWVSVTSAHGGSAYYGEFVKGRFTMSRDHFIDTVYLEMNGLTVEDTAVYYCVRVTFYHEGSGYYYRAGNYFDSWGKGTRVVVSA

SEQ ID NO: 8700 - protein, 122 aa, Artificial Sequence
  Description of Artificial Sequence: Synthetic polypeptide
EVQLVESGGGLVQAGGSLRLSCAASGFSFNDYAIGWFRQTPGKEREGVSCLSSSGMAHYADSVKGRFTIAYDNAKNTVYLQMNSLKPEDTAVYHCATHPFRCGNWRTVMGSWGQGTQVTVSS

SEQ ID NO: 8701 - protein, 122 aa, Artificial Sequence
  Description of Artificial Sequence: Synthetic polypeptide
EVQLVESGGGLVQAGGSLRLSCETSGFTFDDYGIGWFRQAPGKGREGISCISGSGIAHYGDSVKGRFTISSDNAKNTVYLQMNSLKPEDTGLYYCATTPFRCGNWRTTMGSWGQGTQVTVSS

SEQ ID NO: 8702 - protein, 119 aa, Artificial Sequence
  Description of Artificial Sequence: Synthetic polypeptide
EVQLVESGGGLVQAGGSLRLSCEASTSMFSIRAATWYRQAPGKQRELVANIDSEGTTGYSDSVKGRFTISRDNTKKTVYLQMNSLKPEDTAVYSCNAVVTYNMLVYDSWGQGTQVTVSS

SEQ ID NO: 8703 - protein, 135 aa, Artificial Sequence
  Description of Artificial Sequence: Synthetic polypeptide
QVQLVQPGTAMKSLGSSLTITCRVSGDDLGSFHFGTYFMIWVRQAPGQGLEYMGGILPSTKTPTYAHKFRGRVSISAPGVPPVLSLALTNLTYDDTATYFCARERGRHFEPKNRDNLEGKFFDLWGRGTFVRVSP

SEQ ID NO: 8704 - protein, 132 aa, Artificial Sequence
  Description of Artificial Sequence: Synthetic polypeptide
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGDALRGRYFDFWGRGTGVSVSA

SEQ ID NO: 8705 - protein, 135 aa, Artificial Sequence
  Description of Artificial Sequence: Synthetic polypeptide
QLQLDQPGAAMKSLGSSLTITCRVSGDDLGSFHFGTYFMIWVRQGPGQGLEYMGGILPSTKTPTYAHKFRGRVSISAPGVPPVLSLALTNLTYDDTATYFCARERGRHFEPKNRDHLEGKFLDLWGRGTFVRVSP

SEQ ID NO: 8706 - protein, 130 aa, Artificial Sequence
  Description of Artificial Sequence: Synthetic polypeptide
QVQLVQSGAVVKSPGSSAKLSCRLLGDEFGTYFISWIRQAPGRGLEWVGGIVPHSQLQSSAQKFHGRFFITGGVTPPIIFLQLTNVTFEDTGTYFCARERGRHRDPKTGKSLRGRYFDFWGRGTGVTVSP

SEQ ID NO: 8707 - protein, 134 aa, Artificial Sequence
  Description of Artificial Sequence: Synthetic polypeptide
QPYIVQSGPAVKGAGSSVTVTCKVDGDDDGIFSFGTYFMVWVRQAPGQGLQYMGGLVPSYAPTYAHKFEGRITISAAGTPPVVSLTLLNLTNDDAATYFCARERGRHYDSKTRENRRGRYFDMWGRGTRITVSP

SEQ ID NO: 8708 - protein, 134 aa, Artificial Sequence
  Description of Artificial Sequence: Synthetic polypeptide
QPYIVQSGPAVKGAGSSVTVTCRVDGDDDGIFNFGTYFMVWVRQAPGQGLQYMGGLVPSYAPTYAHKFEGRITISAAGTPPVVSLTLINLTNADAATYFCARERGRHYDSKTRENRRGRYFDMWGRGTRITVSP

SEQ ID NO: 8709 - protein, 130 aa, Artificial Sequence
  Description of Artificial Sequence: Synthetic polypeptide
QIELRQSGAAMKSPGSSVKLSCTVLGENFGTYFISWIRQAPGQGLEWVGGIVPHSQLQSSAQKFHGRIKISGGGTPPVVSLELTNVTFDDTGTYFCARERGRHVEPKTGDRLAGRYFDIWGRGTGLRVSP

SEQ ID NO: 8710 - protein, 132 aa, Artificial Sequence
  Description of Artificial Sequence: Synthetic polypeptide
QVQLVQSGAAVKSPGSSAKLSCTVLGDEFGTYFISWIRQAPGQGLEWVGGIVPHSQLQSSAQRFHGRITISAGAGVTPPVVSLQLTNLTFDDAGTYFCARERGRHRDPKTGDALRGRYFDFWGRGTGISVSP

SEQ ID NO: 8711 - protein, 135 aa, Artificial Sequence
  Description of Artificial Sequence: Synthetic polypeptide
QVQLVQPGTAMKTLGSSLTISCRVSGDDGNFHFGTYFMAWVRQVPGQGLEYMGGILPSTKSPTYAHKFRGRVSISTAGVPPVVSLALTNLTYDDTATYFCARERGRHYDSKKQENYRGKFFDLWGRGTWVRVSPT

SEQ ID NO: 8712 - protein, 130 aa, Artificial Sequence
  Description of Artificial Sequence: Synthetic polypeptide
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLFGVPIARGPVNAMDVWGQGITVTI

SEQ ID NO: 8713 - protein, 136 aa, Artificial Sequence
  Description of Artificial Sequence: Synthetic polypeptide
LLEQSGAEVRKPGSSVKLSCKASEGSFNTYIIHWMRQAPGQGLEWVGRVIPALSMANYAQKFQGRISITADTSTDTAFLNLRSLTSDDTAVYYCATDGSRLSTSAFDFWSGNRPSSYIDVWGKGTAVTVSSASTKG

SEQ ID NO: 8714 - protein, 237 aa, Artificial Sequence
  Description of Artificial Sequence: Synthetic polypeptide
EVQLVESGGGLIRPGGSLRLSCKGSGFIFENFGFGWVRQGPGKGLEWVSGTNWNGGDSRYGDSVKGRFTISRDNSNNFVYLQMNSLRPEDTAIYYCARGTDYTIDDQGIRYQGSGTFWYFDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 8715 - protein, 226 aa, Artificial Sequence
  Description of Artificial Sequence: Synthetic polypeptide
EVQLVESGGGLVQPGGSLRLSCAASGFTFSTYAMSWVRQAPGKGLEWVSSINNSGRNTFSADSVKGRFTISRDNSKNTLFLVMNSLRAEDTAVYYCAKDLRLGGGSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 8716 - protein, 229 aa, Artificial Sequence
  Description of Artificial Sequence: Synthetic polypeptide
EVQLVESGPGLVKPSQTLSLTCTVSGASISSGGYFWSWIRQHPGKGLEWIGNIYYIGNTYYNPSLKSRLTISVDTTQNQFSLKLTSVTAADTAVYYCARVPRLRGGNYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 8717 - protein, 229 aa, Artificial Sequence
  Description of Artificial Sequence: Synthetic polypeptide
  MOD_RES (1)..(1): Any amino acid
XVRLSQSGGQMKKPGESMRLSCRASGYEFLNCPINWIRLAPGRRPEWMGWLKPRGGAVNYARKFQGRVTMTRDVYSDTAFLELRSLTSDDTAVYFCTRGKYCTARDYYNWDFEHWGRGAPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCD

SEQ ID NO: 8718 - protein, 239 aa, Artificial Sequence
  Description of Artificial Sequence: Synthetic polypeptide
  MOD_RES (1)..(1): Any amino acid
XPQLQESGPGLVEASETLSLTCTVSGDSTGRCNYFWGWVRQPPGKGLEWIGSLSHCRSYYNTDWTYHNPSLKSRLTISLDTPKNQVFLRLTSVTAADTATYYCARFGGEVLVYRDWPKPAWVDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCD

SEQ ID NO: 8719 - protein, 239 aa, Artificial Sequence
  Description of Artificial Sequence: Synthetic polypeptide
  MOD_RES (1)..(1): Any amino acid
XPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCD

SEQ ID NO: 8720 - protein, 448 aa, Artificial Sequence
  Description of Artificial Sequence: Synthetic polypeptide
QVQLVQSGAEVKKPGASVKVSCKASGYTFTNSWIGWFRQAPGQGLEWIGDIYPGGGYTNYNEIFKGKATMTADTSTNTAYMELSSLRSEDTAVYYCSRGIPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 8721 - protein, 128 aa, Artificial Sequence
  Description of Artificial Sequence: Synthetic polypeptide
LEVQLQESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTDPYSSGWYTGYYGMDVWGQGTTVTVSS

SEQ ID NO: 8722 - protein, 123 aa, Artificial Sequence
  Description of Artificial Sequence: Synthetic polypeptide
LEVQLQESGPGLVKPSQTLSLTCTVSGGSISSGGYYWSWIRQHPGKGLEWIGYIYNSGSTYYNPSLKSRVTISIDTSKNKFSLKLSSVTAADTAVYYCARAAYCGGDCSFDYWGQGTLVTVSS

SEQ ID NO: 8723 - protein, 123 aa, Artificial Sequence; identical to SEQ ID NO: 8722
  Description of Artificial Sequence: Synthetic polypeptide

SEQ ID NO: 8724 - protein, 125 aa, Artificial Sequence
  Description of Artificial Sequence: Synthetic polypeptide
LEVQLQESGGGLVQPGGSLRLSCAASGFTFSTYSMNWVRQAPGKGLEWISYITSSSSAIYYADSVKGRFTISRDNAKNSLYLQMNSLRAEDTAVYYCARDLMGGIFGYSYGVDVWGQGTTVTVSS

SEQ ID NO: 8725 - protein, 123 aa, Artificial Sequence
  Description of Artificial Sequence: Synthetic polypeptide
LEVQLVESGGGLVQPGGSLRLSCAASGFTFSSYVMTWVRQDPGKGLEWVSTISGSGGSTYYADSVKGRFTMSRDNSKNMLYLQMNSLRAEDTAVYYCAKDHRRHLFGDYDDYWGQGTLVTVSS

SEQ ID NO: 8726 - protein, 123 aa, Artificial Sequence; identical to SEQ ID NO: 8725
  Description of Artificial Sequence: Synthetic polypeptide

SEQ ID NO: 8727 - protein, 124 aa, Artificial Sequence
  Description of Artificial Sequence: Synthetic polypeptide
LEVQLQESGPGLVKPSETLSLTCTVSGGSISSSSYYWGWIRQPPGKGLEWIGSIYYSGSTYYNPSLKSRVTISVDTSKNQFSLKLSSVTAAYTAVYYCARRCTSGVCYGAFDYWGQGTPVTVSS

SEQ ID NO: 8728 - protein, 120 aa, Artificial Sequence
  Description of Artificial Sequence: Synthetic polypeptide
LEVQLQESGAGLLKPSETLSLTCAVYGGSFSGYFWSWIRQPPGKGLEWIGEINPSGSTNYNPSLKSRVTISVDTSKNQFSLKLSSVTAADTAVYYCARARIFGFGPFDYWGQGTLVTVSS

SEQ ID NO: 8729 - protein, 114 aa, Artificial Sequence
  Description of Artificial Sequence: Synthetic polypeptide
LEVQLVESGGGLVQPGGSLRLYCAASGFTFSDYGMNWVRQAPGKGLEWVSSSGATTYYADSVKGRFTMSRDNSKNTLFLQMNSLRAEDTALYYCARGILHPASWGQGILVTVSS

SEQ ID NO: 8730 - protein, 115 aa, Artificial Sequence
  Description of Artificial Sequence: Synthetic polypeptide
LEVQLVESGGGLVQPGGSLRLSCAASGFTFSDYGMTWVRQAPGKGLEWVSSSGATTYYPDSVKGRFTMSRDNSKNTLFLQMNSLRPEDTALYYCPRGILHPRPLWGQGTLVTVSS

SEQ ID NO: 8731 - protein, 126 aa, Artificial Sequence
  Description of Artificial Sequence: Synthetic polypeptide
LEVQLQESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTGAVWLHYDYYYVMDVWGQGTTVTVSS

SEQ ID NO: 8732 - protein, 123 aa, Artificial Sequence
  Description of Artificial Sequence: Synthetic polypeptide
LEVQLQESGGGLVKPGGSLRLSCAASGFTFSNAWMSWVRQAPGKGLEWVGRIKSKTDGGTTDYAAPVKGRFTISRDDSKNTLYLQMNSLKTEDTAVYYCTTAPARPAEYFQHWGQGTLVTVSS

SEQ ID NO: 8733 - protein, 129 aa, Artificial Sequence
  Description of Artificial Sequence: Synthetic polypeptide
LEVQLQESGGGLVQPGGSLRLSCAASGFTFSNAWMNWVRQAPGKGLELVGRTKSKTDGGTTDYTAPVKGRFTISRDDSKNTLYLQMNSLKTEDTAVYYCTTARIRRSTMIVEEDAFDIWGQGTMVTVSS

SEQ ID NO: 8734 - protein, 122 aa, Artificial Sequence
  Description of Artificial Sequence: Synthetic polypeptide
LEVQLQESGPGLVKPSETLSLTCTVSGASISSDYWSWIRQPPGKGLEWIGYIYYSGGHVHNPSLTSRVTVSMDKSKNQFALNLTSVSAADTAVYYCARSDTIPVFRNGMDVWGQGTTVTVSS

SEQ ID NO: 8735 - protein, 122 aa, Artificial Sequence
  Description of Artificial Sequence: Synthetic polypeptide
LEVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARDMLRDSTGLCYWGRGTLVTVSS

SEQ ID NO: 8736 - protein, 119 aa, Artificial Sequence
  Description of Artificial Sequence: Synthetic polypeptide
EVQLVESGAEVKKPGESLRISCKGSGYSFTSYWISWVRQMPGKGLEWMGRIDPNDSYTNYIPSFQGHITISADKSINTAYLQWSSLKASDTAMYYCARLTLNQYGEGYWGQGTLVTVSS

SEQ ID NO: 8737 - protein, 120 aa, Artificial Sequence
  Description of Artificial Sequence: Synthetic polypeptide
LEVQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARGVVVDWFDPWGQGTLVTVSS

SEQ ID NO: 8738 - protein, 125 aa, Artificial Sequence
  Description of Artificial Sequence: Synthetic polypeptide
LEVQLVESGGGLVQPGGSLRLSCAASGFTFSSYWMSWVRQAPGKGLEWVANIKQDGSEKYYVDSVKGRFTIFRNNAKNSLYLQMNSLRAEDTAVYYCASCYYGSGSYYFYPFAYWGQGTLVTVSS

SEQ ID NO: 8739 - protein, 123 aa, Artificial Sequence
  Description of Artificial Sequence: Synthetic polypeptide
LEVQLVESGGGLVKPAGSLTLSCAVSGFTFSSYWMSWVIQPPPKGLEWVIRIIHHRGNNYYVDSVKGRFTISIDNSKNSLYLQMNSLTAEDTAVYYCARLYQDLETSYVYGYWGQGTLITVSS

SEQ ID NO: 8740 - protein, 123 aa, Artificial Sequence
  Description of Artificial Sequence: Synthetic polypeptide
  MOD_RES (100)..(100): Any amino acid
LEVQLVESGGGLVQPAGSLRLSCAASGFTFSSYWMSWVRLAPRKGLEWVANIQDGSEKYYVDSVKGRFIIFTYNANSLYLQMNSLITEDTAVYYCASCYXGSGSYYFYPFAYWGHGNLVTVSS

SEQ ID NO: 8741 - protein, 108 aa, Artificial Sequence
  Description of Artificial Sequence: Synthetic polypeptide
DLVMTQSPATLSVSSGERTTLSCRASQNVSSNLAWYQQKPGQAPRLLIYDASNRATGIPDTFIGSGSGTDFTLTISRLEPEDLAVYYCQQYGSSPRTFGQGTKVEIKR

SEQ ID NO: 8742 - protein, 108 aa, Artificial Sequence
  Description of Artificial Sequence: Synthetic polypeptide
DLVMTQSPGTLSLSPGERATLSCRASQSVSSYLAWYQQKPGQAPRLLIYDASSRATGIPARFSGSGSGTDFTLTISSLEPEDFAVYYCQDCSNWQSTFGQGTRLDIRR

SEQ ID NO: 8743 - protein, 108 aa, Artificial Sequence
  Description of Artificial Sequence: Synthetic polypeptide
DLQMTQSPATLSVSPGERATLSCRASQSVSSNLAWYQQKPGQAPRLLIYGASTRATGIPARFSGSGSGTEFTLTISSLQSEDFATYYCQQTYSTPRPVGQGTKVEIKR

SEQ ID NO: 8744 - protein, 109 aa, Artificial Sequence
  Description of Artificial Sequence: Synthetic polypeptide
DLVLTQSPGTLSLSPGERATLSCRASQSVRSSYLAWYQLKTGQAPRLLIYDASRRATGIPDRFSGSGSGTDFTLTISRLEPEDYAVYSCQQYGSSPRTFGQGTKVEIKR

SEQ ID NO: 8745 - protein, 106 aa, Artificial Sequence
  Description of Artificial Sequence: Synthetic polypeptide
DLQMTQSPSSLSASVGDRVTFTCRASQSISSSLNWYQQKPGKAPKLLIYAASSLQSGVPSRFSGSGSGTDFTLTISSLQPEDFATYYCQQSYSRTFGQGTKVEIKR

SEQ ID NO: 8746 - protein, 108 aa, Artificial Sequence
  Description of Artificial Sequence: Synthetic polypeptide
DLCLTQSPATLSLSPGERATLSCRASQSVSSSQLAWYQQKPGQAPRLLIYGASSRATGIPDRFSGSGSGTDFTLTISRLEPEDFAVYYCQQYGSSPTFGQGTKLEIKR

SEQ ID NO: 8747 - protein, 109 aa, Artificial Sequence
  Description of Artificial Sequence: Synthetic polypeptide
DLVLTQSPATLSLSPGERATLSCRASQSVSSYLAWYQQKPGQAPRLLIYDASNRATGIPARFSGSGSGTDFTLTISSLEPEDFAVYYCHQYSNWPPWTFGQGTKVEIKR

SEQ ID NO: 8748 - protein, 108 aa, Artificial Sequence
  Description of Artificial Sequence: Synthetic polypeptide
DLVMTQSPSFLSASVGDRVTITCRASQGISSYLAWYQQKSGKAPKLLIYGTSILQSGVPSRFSGSGSGTESTLTISSLQPEDFATYYCQQLNSYPITFGQGTRLEIKR

SEQ ID NO: 8749 - protein, 109 aa, Artificial Sequence
  Description of Artificial Sequence: Synthetic polypeptide
DLVLTQSPATLSVSPGERATLSCRASQSVSSNLAWYQQKPGQAPRLLIYGASSRATGIPDRLSGSGSGTDFTLTISRLEPEDFAVYYCQQYGSSLSWTFGQGTKVEIKR

SEQ ID NO: 8750 - protein, 110 aa, Artificial Sequence
  Description of Artificial Sequence: Synthetic polypeptide
DLVLTQSPGTLCLCPGERATLSCRASESVSSSYLAWYQQKPGQAPRLLIYGASSRATGIPDRFSGSGSGTDFTLTISRLDPEDFAVYYCQQYGRSPMCSFGQGTKLEIKR

SEQ ID NO: 8751 - protein, 109 aa, Artificial Sequence
  Description of Artificial Sequence: Synthetic polypeptide
DLVMTQSPGTLSLSPGERATLSCRASQSVSSSYLAWYQQKPGQAPRLLIYGTSSRATGIPDRFSGSGSGTEFTLTISRLEPEDFAVYYCQQYATSPRTFGQGTKVEIKR

SEQ ID NO: 8752 - protein, 113 aa, Artificial Sequence
  Description of Artificial Sequence: Synthetic polypeptide
DLVMTQSPDSLAVSLGERATINCKSSQSVLYSSNNKNYLAWYQQKPGQPPKLLIYWASTRESGVPDRFSGSGSGTDFTLTISSLQAEDVAVYYCQQYFNTPTFGGGTKVEIKR

SEQ ID NO: 8753 - protein, 108 aa, Artificial Sequence
  Description of Artificial Sequence: Synthetic polypeptide
LVLTQSPGTLSLSPGERATLSCRASQSVSSIYLAWYQQKPGQAPRLLIYGASSRATGIPDRFSGSGSGTDFTLTISRLEPEDFAVYYCQQYGSSPWTFGQGTKVEIKR

SEQ ID NO: 8754 - protein, 107 aa, Artificial Sequence
  Description of Artificial Sequence: Synthetic polypeptide
DLVLTQSPATLSVSPGERATLSCRASQSVSSNLAWYQQKPGQAPRLLIYGASSRATGIPDRFSGSGSGTDFTLTISRLEPEDFAVYYCQQYGSSPYTFGQGTKLEIK

SEQ ID NO: 8755 - protein, 108 aa, Artificial Sequence
  Description of Artificial Sequence: Synthetic polypeptide
DLQMTQSPSSLSASVGDRVTITCRASQSISSYLNWYQQKPGKAPNLLIYAAFSLQSGVPARFSGSGSGTDFTLTISSLQPEDFATYYCQQSYSPPRTFGPGTKVDIKR

SEQ ID NO: 8756 - protein, 109 aa, Artificial Sequence
  Description of Artificial Sequence: Synthetic polypeptide
DLVLTQSPGTLSLSPGERATLSCRASQSVSSIYLAWYQQKPGQAPRLLIYGASSRATGIPDRFSGSGSGTDFTLTISRLEPEDFAVYYCQQSGSSPWTFGQGTKVEIKR

SEQ ID NO: 8757 - protein, 108 aa, Artificial Sequence; identical to SEQ ID NO: 8741
  Description of Artificial Sequence: Synthetic polypeptide

SEQ ID NO: 8758 - protein, 114 aa, Artificial Sequence
  Description of Artificial Sequence: Synthetic polypeptide
DLQMTQSPDFLAVSLGERATINCRSSQSVLYSSNNKNYLAWYQQKPGQPPKLLIYWASIRESGVPDRFSGSGSETDFTLTISSLQAEDVAVYYCQQYYNIPPTFGPGTKVHIKR

SEQ ID NO: 8759 - protein, 110 aa, Artificial Sequence
  Description of Artificial Sequence: Synthetic polypeptide
DLVLTQSPGTLSLSPGERTTLSCRASQSLSSNYLAWYQQKRGQAPRLLIYGASSRATGIPNRFSGSGSGTNFTLTISRLEPENFAVYYCQQYGSSPPYTFGQGTNLEIKR

SEQ ID NO: 8760 - protein, 110 aa, Artificial Sequence
  Description of Artificial Sequence: Synthetic polypeptide
DLVMTQSPSSLSASVGDRVTITCRASQGISSDLNWYHQKPGKAPKRLIYAASTLQSGVPSKFSGSGSGTYFSPTISSLQPEDYATYYCRQHYGYSPPTSFGQGTKLEIKR

SEQ ID NO: 8761 - protein, 110 aa, Artificial Sequence
  Description of Artificial Sequence: Synthetic polypeptide
DLVLTQSPDTLSLSPGERATLSCRASQSLSSNYLTWYQQKRGQAPRLLIYGASSRATGIPDRFSGNGSGTNFSLNISRLEPENFAVYYCQQYGSSPPYTFGQGTNLEIKR

SEQ ID NO: 8762 - protein, 214 aa, Artificial Sequence
  Description of Artificial Sequence: Synthetic polypeptide
DIQLTQSPSSLSASVGDRVTVTCRASQTIHTYLNWYQQIPGKAPKLLIYGASTLQSGVPSRFSGSGSGTDFTLTINSLQPEDFATYYCQQSYSTPRTFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8763 - protein, 107 aa, Artificial Sequence
  Description of Artificial Sequence: Synthetic polypeptide
DIQLTQSPSSLSASVGDRVSITCRASQTINNYLNWYQQTPGKAPKLLIYGASNLQNGVPSRFSGSGSGTDFTLTISSLQPEDFATYYCQQSFSTPRTFGQGTRLDIK

SEQ ID NO: 8764 - protein, 107 aa, Artificial Sequence
  Description of Artificial Sequence: Synthetic polypeptide
DIQLTQSPSSLSASVGDRVTVTCRASQTIHTYLNWYQQIPGKAPKLLIYGASTLQSGVPSRFSGSGSGTDFTLTINSLQPEDFATYYCQQSYSTPRTFGQGTRLDIK

SEQ ID NO: 8765 - protein, 214 aa, Artificial Sequence
  Description of Artificial Sequence: Synthetic polypeptide
DIQLTQSPSSLSASVGDRVSITCRASQTINNYLNWYQQTPGKAPKLLIYGASNLQNGVPSRFSGSGSGTDFTLTISSLQPEDFATYYCQQSFSTPRTFGQGTRLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8766 - protein, 216 aa, Artificial Sequence
  Description of Artificial Sequence: Synthetic polypeptide
QSALTQPASVSGSPGQTITISCNGTSRDVGGFDSVSWYQQSPGKAPKVMVFDVSHRPSGMSNRFSGSKSGNTASLTISGLHIEDEGDYFCSSLTDRSHRIFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8767 - protein, 216 aa, Artificial Sequence
  Description of Artificial Sequence: Synthetic polypeptide
QSALTQPASVSGSPGQTITISCNGTRSDVGGFDSVSWYQQSPGRAPKVMVFDVSHRPSGISNRFSGSKSGNTASLTISGLHIEDEGDYFCSSLTDRSHRIFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8768 - protein, 216 aa, Artificial Sequence
  Description of Artificial Sequence: Synthetic polypeptide
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8769 - protein, 215 aa, Artificial Sequence
  Description of Artificial Sequence: Synthetic polypeptide
SYELTQPPSVSVSPGQTASITCSGSKLGDKYVSWYQLRPGQSPILVMYENDRRPSGIPERFSGSNSGDTATLTISGTQALDEADFYCQAWETTTTTFVFFGGGTQLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8770 - protein, 110 aa, Artificial Sequence
  Description of Artificial Sequence: Synthetic polypeptide
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVL

SEQ ID NO: 8771 - protein, 109 aa, Artificial Sequence
  Description of Artificial Sequence: Synthetic polypeptide
SYELTQPPSVSVSPGQTASITCSGSKLGDKYVSWYQLRPGQSPILVMYENDRRPSGIPERFSGSNSGDTATLTISGTQALDEADFYCQAWETTTTTFVFFGGGTQLTVL

SEQ ID NO: 8772 - protein, 110 aa, Artificial Sequence
  Description of Artificial Sequence: Synthetic polypeptide
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVL

SEQ ID NO: 8773 - protein, 110 aa, Artificial Sequence
  Description of Artificial Sequence: Synthetic polypeptide
QSALTQPASVSGSPGQTITISCNGTSRDVGGFDSVSWYQQSPGKAPKVMVFDVSHRPSGMSNRFSGSKSGNTASLTISGLHIEDEGDYFCSSLTDRSHRIFGGGTKLTVL

SEQ ID NO: 8774 - protein, 216 aa, Artificial Sequence; identical to SEQ ID NO: 7672
  Description of Artificial Sequence: Synthetic polypeptide

SEQ ID NO: 8775 - protein, 216 aa, Artificial Sequence
  Description of Artificial Sequence: Synthetic polypeptide
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8776 - protein, 215 aa, Artificial Sequence
  Description of Artificial Sequence: Synthetic polypeptide
DIVMNQSPPSLAVTPGEPASISCRASQSLLYSDGHNYLDWYLQKPGQAPQLLIYLGSTRASGVPDRFSGSGSGTDFTLKISRVEAEDVGVYYCMQPLQSYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 8777 - protein, 213 aa, Artificial Sequence
  Description of Artificial Sequence: Synthetic polypeptide
DIELTQPPSVSVVPGQTARISCSGDNIPYEYASWYQQKPGQAPVLVIYGDNNRPSGIPERFSGSNSGNTATLTISGTQAEDEADYYCASWDSMTVDGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEA

SEQ ID NO: 8778 - protein, 109 aa, Artificial Sequence
  Description of Artificial Sequence: Synthetic polypeptide
SYELTQETGVSVALGRTVTITCRGDSLRSHYASWYQKKPGQAPILLFYGKNNRPSGVPDRFSGSASGNRASLTISGAQAEDDAEYYCSSRDKSGSRLSVFGGGTKLTVL

SEQ ID NO: 8779 - protein, 215 aa, Artificial Sequence
  Description of Artificial Sequence: Synthetic polypeptide
SYELTQETGVSVALGRTVTITCRGDSLRSHYASWYQKKPGQAPILLFYGKNNRPSGVPDRFSGSASGNRASLTISGAQAEDDAEYYCSSRDKSGSRLSVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8780 - protein, 121 aa, Artificial Sequence
  Description of Artificial Sequence: Synthetic polypeptide
DIQMTQSPSSLSASVGDRVTITCQAGQGIGSSLQWYQQKPGKAPKLLVHGASNLHRGVPSRFSGSGFHTTFSLTISGLQRDDFATYFCAVVEFFGPGTKVDIKRTVAAPSVFIFPPSDEQL

SEQ ID NO: 8781 - protein, 122 aa, Artificial Sequence
  Description of Artificial Sequence: Synthetic polypeptide
DIQMTQSPSSLSASVGDRVTITCQASQGIGSSLQWYQQKPGRAPNLLVHGASKLHRGVPSRFSGSGFHTTFSLTISGLQRDDFATYFCAVLEFFGPGTKVEIKRTVAAPSVFIFPPSDEQLK

SEQ ID NO: 8782 - protein, 105 aa, Artificial Sequence
  Description of Artificial Sequence: Synthetic polypeptide
DIQMTQSPSSLSASVGDRVSINCQAGQGLGSSLNWYQQKPGRAPKLLVHGASNLQRGVPSRFSGSGFHTTFTLTISSLQPDDVATYFCAAFQWFGPGTKVEIKRT

SEQ ID NO: 8783 - protein, 102 aa, Artificial Sequence
  Description of Artificial Sequence: Synthetic polypeptide
DIQMTQSPSSLSASVGDRVSIHCQAGQGIGSSLNWYQQKPGRAPRLLVHGASNLQRGVPSRFSGSGFHTTFTLTISSLQPDDVATYWCAALEFFGPGTKVEI

SEQ ID NO: 8784 - protein, 122 aa, Artificial Sequence
  Description of Artificial Sequence: Synthetic polypeptide
DIQMTQSPSSLSASVGDRVTINCQAGQGIGSSLNWYQKKPGRAPKLLVHGASNLQRGVPSRFSGSGFHTTFTLTISSLQPDDVATYFCAVFQWFGPGTKVDIKRTVAAPSVFIFPPSDEQLK

SEQ ID NO: 8785 - protein, 210 aa, Artificial Sequence
  Description of Artificial Sequence: Synthetic polypeptide
DIQMTQSPSSLSASVGDRVTINCQAGQGIGSSLNWYQKKPGRAPKLLVHGASNLQRGVPSRFSGSGFHTTFTLTISSLQPDDVATYFCAVFQWFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

SEQ ID NO: 8786 - protein, 120 aa, Artificial Sequence
  Description of Artificial Sequence: Synthetic polypeptide
DIQMTQSPSSLSASVGDRVTITCQAGQGIGSSLNWYQQKPGRAPKLLVYGASNLQRGVPSRFSGSGFHTTFTLTISSLQPEDFATYFCSVYEFLGPGTKVEIKRTVAAPSVFIFPPSDEQ

SEQ ID NO: 8787 - protein, 120 aa, Artificial Sequence
  Description of Artificial Sequence: Synthetic polypeptide
DIQMTQSPSSLSVSVGDRVSITCRATQGIGNSLNWYQQKPGKAPKVLIYGTTKLHGGVPSRFSGGGSGSTGTLTIDSLQPEDIATYFCQLFEFFGPGTKVEIKRTVAAPSVFIFPPSDEQ

SEQ ID NO: 8788 - protein, 120 aa, Artificial Sequence
  Description of Artificial Sequence: Synthetic polypeptide
DIQMTQSPSSLSASVGDRVTITCQASQGIGSSLQWYQQKPGRAPNLLVHGASNLHRGVPSRFSGSGFHTTFSLTISGLQRDDFATYFCAVLEFFGPGTKVDIKRTVAAPSVFIFPPSDEQ

SEQ ID NO: 8789 - protein, 120 aa, Artificial Sequence
  Description of Artificial Sequence: Synthetic polypeptide
DIQMTQSPSSLPASVGDTVTITCQAGQGIGSSLQWYQQRPGRAPNLLVYDASNLQRGVPSRFTGTGFHTTFTLTIRGLRPEDFGTYFCASLEFFGPGTKVDIKRTVAAPSVFIFPPSDEQ

SEQ ID NO: 8790 - protein, 120 aa, Artificial Sequence
  Description of Artificial Sequence: Synthetic polypeptide
YIQMTQSPSSLSASIGDRVTITCQAGQGIGSSLNWYQQKPGKAPKLLVHGASNLQRGVSSRFSGSGFHTTFTLTISSLRPEDVGTYFCEVYEFIGPGTKVDIKRTVAAPSVFIFPPSDEQ

SEQ ID NO: 8791 - protein, 120 aa, Artificial Sequence
  Description of Artificial Sequence: Synthetic polypeptide
DIQMTQSPSSLSASVGDRVSINCQAGQGIGSSLNWYQQKRGKAPKLLVHGASTLQRGVPSRFSGSGFHTTFTLTISSLQPDDVATYFCESFQWFGPGTKVEIKRTVAAPSVFIFPPSDEQ

SEQ ID NO: 8792 - protein, 120 aa, Artificial Sequence
  Description of Artificial Sequence: Synthetic polypeptide
DIQMTQSPSSLSASVGDRVTITCQASQGIGSSLQWYQQKPGRAPKLLVHGASNLHRGVPSRFSGSGFHTSFTLTISSLQPDDVATYFCAVLEFFGPGTKVEIKRTVAAPSVFIFPPSDEQ

SEQ ID NO: 8793 - protein, 120 aa, Artificial Sequence
  Description of Artificial Sequence: Synthetic polypeptide
DIQMTQSPSSLSASVGDRVSIHCQAGQGIGSSLKWYQQKSGRAPRLLVHGASNLQRGVPSRFSGSGFHTTFTLTISSLQPDDVATYWCAVLEFFGPGTKVEIKRTVAAPSVFIFPPSDEQ

SEQ ID NO: 8794 - protein, 129 aa, Artificial Sequence
  Description of Artificial Sequence: Synthetic polypeptide
QSVLTQPPSASGAPGQRVTISCSGGPSNVGGNYVYWYRQFPGTAPNLLILRDDQRPSGVPDRFSASKSGNSASLAISGLRPDDEAFYFCATYDSDGSVRLFGGGTTLTVLSQPKAAPSVTLFPPSNGGR

SEQ ID NO: 8795 - protein, 214 aa, Artificial Sequence
  Description of Artificial Sequence: Synthetic polypeptide
ELELTQSPATLSVSPGERATLSCRASESVSSDLAWYQQKPGQAPRLLIYGASTRATGVPARFSGSGSGAEFTLTISSLQSEDFAVYYCQQYNNWPPRYTFGQGTRLEIKRTVAAPSVFIFPPSDEQLKSGTASVVCLLNNFYPREAKVQWKVDNALQSGNSQESVTEQKSKDSTYSLSSTLTLSKADYEKHKVYACEVTHQGLSSPVTKSFNRG

SEQ ID NO: 8796 - protein, 215 aa, Artificial Sequence
  Description of Artificial Sequence: Synthetic polypeptide
QSALTQPPSASGAPGQRVTISCSGGPSNVGGNYVYWYRQFPGTAPTLLILRDDQRPSGVPDRFSASKSGNSASLAISGLRPDDEGFYFCATYDSDGSIRLFGGGTALTVLSQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTEC

SEQ ID NO: 8797 - protein, 110 aa, Artificial Sequence
  Description of Artificial Sequence: Synthetic polypeptide
EEDAATYYCQLCNEDPPTFGAGTKQQQKDIVLTNSPASLAVSLGQRATISCKASQSVDYDGDSYMWYQQKPGQPPKLLTIAASNLESGIPARFSGSGSGTDFTLNIHPVE

SEQ ID NO: 8798 - protein, 112 aa, Artificial Sequence
  Description of Artificial Sequence: Synthetic polypeptide
NFMLTQVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQ

SEQ ID NO: 8799 - protein, 210 aa, Artificial Sequence
  Description of Artificial Sequence: Synthetic polypeptide
DIQMTQSPSFVSASVGDRVTITCRASQGISSYLAWYQQKPGKAPKLVIYAASTLQSGVPSRFSGSGSGTEFTLTISSLQPEDFATYYCQHLIGLRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 8800 - protein, 214 aa, Artificial Sequence
  Description of Artificial Sequence: Synthetic polypeptide
ALQLTQSPSSLSASVGDRITITCRASQGVTSALAWYRQKPGSPPQLLIYDASSLESGVPSRFSGSGSGTEFTLTISTLRPEDFATYYCQQLHFYPHTFGGGTRVDVRRTVAAPSVFIFPPSDEQLKSGTASVVCLLNNFYPREAKVQWKVDNALQSGNSQESVTEQDSKDSTYSLSSTLTLSKADYEKHKVYECEVTHQGLSSPVTKSFNRGEC

SEQ ID NO: 8801 - protein, 117 aa, Artificial Sequence
  Description of Artificial Sequence: Synthetic polypeptide
DIQMTQSPSTLSASIGDTVRISCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVF

SEQ ID NO: 8802 - protein, 117 aa, Artificial Sequence
  Description of Artificial Sequence: Synthetic polypeptide
DIQMTQSPSTLSASIGDTVRISCRASQSITGNWVAWYQQRPGKAPRLLIYRGAALLGGVPSRFSGSAAGTDFTLTIGNLQTEDFGTFYCQQYDTYPGTFGQGTKVEVKRTVAAPSVF

SEQ ID NO: 8803 - protein, 117 aa, Artificial Sequence
  Description of Artificial Sequence: Synthetic polypeptide
DIQMTQSPSTLSASVGDTVRISCRASQSITGGWLAWYHQRPGKAPRLLIYRGSRLLGGVPSRFSGSAAGTDFTLTIANLQAEDFGTFYCQQYDTYPGTFGQGTKVEVKRTVAAPSVF

SEQ ID NO: 8804 - protein, 117 aa, Artificial Sequence
  Description of Artificial Sequence: Synthetic polypeptide
DIQMTQSPSTLSASIGDTVRISCRASQSITGNWVAWYQQRPGKAPRLLIYRGAALLGGVPSRFRGSAAGTDFTLTIGNLQAEDFGTFYCQQYDTYPGTFGQGTKVEVKRTVAAPSVF

SEQ ID NO: 8805 - protein, 65 aa, Artificial Sequence
  Description of Artificial Sequence: Synthetic polypeptide
SRLLGGVPSRFSGSAAGTDFTLTIANLQAEDFGTFYCQQYDTYPGTFGQGTKVEVKRTVAAPSVF

SEQ ID NO: 8806 - protein, 123 aa, Artificial Sequence
  Description of Artificial Sequence: Synthetic polypeptide
  MOD_RES (18)..(18): Any amino acid
  MOD_RES (35)..(35): Any amino acid
EIVLTQSPGTLSLSPGEXATLSCRASQTISNNYLXWYQQKAGQAPRLLIYGASSGATGIPDRFSGSGSGTDFTLTISRLEPEDFAVYYCQQYGLSPWTFGRGTKVEIKRTVAAPSVFIFPPSD

SEQ ID NO: 8807 - protein, 129 aa, Artificial Sequence
  Description of Artificial Sequence: Synthetic polypeptide
QSALTQPRSVSGSPGQSVTISCTGTSSDVGAYNYVSWYRQHPGKAPKLMINDVSKRPSGVPDRFSGSKSGNTASLTISGLQAEDEADYYCCSYAGTYSYVFGTGTKVTVLGQPKANPTVTLFPPSSEEL

SEQ ID NO: 8808 - protein, 116 aa, Artificial Sequence
  Description of Artificial Sequence: Synthetic polypeptide
APVTLSASVGDTVTITCRASQPIATFLNWYQHKPGQAPKLLIYAASTFQRGAPSRYSGSGSGTDFTLTINSLQPEDLATYYCQQTFTDPVTFGQGTRLEIKRTVAAPSVFIFPPSD

SEQ ID NO: 8809 - protein, 122 aa, Artificial Sequence
  Description of Artificial Sequence: Synthetic polypeptide
DIQMTQSPASLSASVGDRVTITCRASQGISHYLAWYQQKPGKVPRLLIYAASRLQSGVTSRFSGSGSGTEFTLTISSLLPEDAAVYFCQKYDTDPMTFGQGTRLEIKRTVAAPSVFIFPPSD

SEQ ID NO: 8810 - protein, 123 aa, Artificial Sequence
  Description of Artificial Sequence: Synthetic polypeptide
DIQMTQSPSSLSASIGDRVTITCRANQHIRSFLNWYQQTPGKAPKLLIYAASTLQRGVPSRFSGSGSGTDFTLTITSLEREDLATYYCQQTYTSPITFGQGTRLEIKRTVAAPSVFIFPPSDE

SEQ ID NO: 8811 - protein, 124 aa, Artificial Sequence
  Description of Artificial Sequence: Synthetic polypeptide
EIVLTQSPGTLSLSPGERATLSCRASQSVSNNYLAWYQQKPGQAPRLLIYGASSRATGIPDRFSGSGSGTDFTLTISRLEPEDFAVYYCQQYATSSLYTFGQGTKLEIKRTVAAPSVFIFPPSD

SEQ ID NO: 8812 - protein, 118 aa, Artificial Sequence
  Description of Artificial Sequence: Synthetic polypeptide
LSVSLGERATINCKSSQSILYSSDKKNYLAWYQQKIGQPPKLLLYWASTRESGIPDRFSGSGSGSDFTLTISSLQPEDVAVYYCQQYYISPFTFGPGTKVDLKRTVAAPSVFIFPPSD

SEQ ID NO: 8813 - protein, 120 aa, Artificial Sequence
  Description of Artificial Sequence: Synthetic polypeptide
NFMLTQPASVSGSPGQSITLSCTGTTSDVRDSNFVSWYQQVPGKAPKLIIYDVSARPSGVSFRFSGSKSGNTASLTISGLQAEDEALYYCSSFTPTNTLVFGGGTKLTVLGQPKAAPSVT

SEQ ID NO: 8814 - protein, 114 aa, Artificial Sequence
  Description of Artificial Sequence: Synthetic polypeptide
SQSVVTQEPSLTVSPGGTVTLTCGPSTGAVTSGFYPHWFQQKPGQAPRALIYSTSNKYSWTPARFSGSLLGGKAVLTLSDVQPDDEAEYYCLLLLYYGGPWIFGGGTKLTVLVS

SEQ ID NO: 8815 - protein, 130 aa, Artificial Sequence
  Description of Artificial Sequence: Synthetic polypeptide
QAVVTQEPSLTVSPGGTVTLTCASSTGAVTSGFYPHWFQQKPGQAPRALIYSTSNRYSWTPARFSGSLLGGKAALTLSGVQPEDEAEYYCLLLPYYGGPWIFGGGTKLTVLGQPKAAPSVTLFPPSSEEL

SEQ ID NO: 8816 - protein, 122 aa, Artificial Sequence
  Description of Artificial Sequence: Synthetic polypeptide
EIVMTQSPATLSVSPGDRATLSCRASQSVSTNLAWYQQKPGQAPRLLIYGASTRATGIPATFSGSGFATEFTLTISSLQSEDFAVYYCQQYNNWPPAFGQGTKVEIKRTVAAPSVFIFPPSD

SEQ ID NO: 8817 - protein, 130 aa, Artificial Sequence
  Description of Artificial Sequence: Synthetic polypeptide
QSVLTQPPSASGSPGQSITISCTGTSSDVGGYNYVSWYQQPPGKAPKVIIYEVSKRPSGVPDRFSGSKSGNTASLTVSGLQAEDEADYYCSSYAGSNNFVFGTGTEVTVVGQPKANPTVTLFPPSSEELL

SEQ ID NO: 8818 - protein, 113 aa, Artificial Sequence
  Description of Artificial Sequence: Synthetic polypeptide
SLSASVGDRVTITCRASESISFYLNWYQQKPGKAPELLIFATSTLHSGVPSRFSGSGSGTDFTLTISSLQLEDFATYYCQQSSSTPFTFGGGTKVEIKRTVAAPSVFIFPPSD

SEQ ID NO: 8819 - protein, 121 aa, Artificial Sequence
  Description of Artificial Sequence: Synthetic polypeptide
DIQMTQSPSSLSAYVGDRVTITCRASQNINTYLNWYQQRPGKAPKLLIYAASTLQSGVPSRFSGSGSGTDFTLTISNLETEDFAVYYCQQTYRSVTFGQGTKLEIKRTVAAPSVFIFPPSD

SEQ ID NO: 8820 - protein, 111 aa, Artificial Sequence
  Description of Artificial Sequence: Synthetic polypeptide
LSAYVGDRVTITCRASQNINTYLNWYQQRPGKAPKLLIYAASTLQSGVPSRFSGSGSGTDFTLTISNLETEDFAVYYCQQTYSSVTFGQGTKLETRRTVAAPSVFIFPPSD

SEQ ID NO: 8821 - protein, 125 aa, Artificial Sequence
  Description of Artificial Sequence: Synthetic polypeptide
SEIVLTQSPGTLSLSPGERATLSCRASQSVSSSYLAWYQQKPVQAPRLLIYGASSRATGIPDRFSGSGSGTDFTLTISRLEPEDFAVYYCQQYGTLHPRTFGQGTKVEIKRTVAAPSVFIFPPSD

SEQ ID NO: 8822 - protein, 90 aa, Artificial Sequence
  Description of Artificial Sequence: Synthetic polypeptide
DVVMTQSPLSLPVTLGQPASISCRSSQSLVYSHGDTYLKCFQQRPGQSPRRPIYKVSNRDSGVPDRFSGSGSGTDFTLKISRVEAEDVGV

SEQ ID NO: 8823 - protein, 122 aa, Artificial Sequence
  Description of Artificial Sequence: Synthetic polypeptide
EIVLTQSPGTLSLSPGERATLSCRASQSISSNYLAWYQQKPGQAPRLLIYGASTRATGIPDRFSGSGSGTDFTLSISRLEPEDIAVYYCHQYGSSQRFGQGTKVEIKRTVAAPSVFIFPPSD

SEQ ID NO: 8824 - protein, 122 aa, Artificial Sequence
  Description of Artificial Sequence: Synthetic polypeptide
DIQMTQSPSSLSASVGDRVTITCRASQSISRYLNWYQQKPGKAPKLLIYAASSLQGGVPSRFSGSGSGTDFTLTISSLQPEDFATYYCQQSSSKPFTFGGGTKVEIKRTVAAPSVFIFPPSD

SEQ ID NO: 8825 - protein, 116 aa, Artificial Sequence
  Description of Artificial Sequence: Synthetic polypeptide
GPATLSVSPGERATLSCRASQSLRNNLAWYQQKTGQSPRLLIYAVSTRATGIPPRFSGGGSGTEFTLTIDSLQSEDFAVYFCQQYDSPQWTFGQGTKVEIKRTVAAPSVFIFPPSD

SEQ ID NO: 8826 - protein, 129 aa, Artificial Sequence
  Description of Artificial Sequence: Synthetic polypeptide
NFMLTQPASVSGSPGQSITISCSGTGSDIGVYNYVSWYQQHPGKAPRLMIYDVTNRPSGVSNRFSGSKSGFTASLTISGLQGDDEADYYCSSYSSTNTYVFGTGTHVTVLGQPKANPTVTLFPPSSEEL

SEQ ID NO: 8827 - protein, 127 aa, Artificial Sequence
  Description of Artificial Sequence: Synthetic polypeptide
QSALTQPPSASGTPGQRVTISCSGSYHNIGSNAVNWYQQLPGTAPKLLIYSNDQRPSGVPDRFSGSKSGTSASLAISGLQSEDEADYYCAAWDDSLHVFGTGTKVTVLGQPKANPTVTLFPPSSEEL

SEQ ID NO: 8828 - protein, 127 aa, Artificial Sequence; identical to SEQ ID NO: 8827
  Description of Artificial Sequence: Synthetic polypeptide

SEQ ID NO: 8829 - protein, 123 aa, Artificial Sequence
  Description of Artificial Sequence: Synthetic polypeptide
DIQMTQSPSSLSASVGDRVTITCRASQDITTYLAWLQQKPGKAPKSLIYSASTVQSGVPSRFSGSGSGTEFTLTISGLQPEDFATYYCQQYNYYPITFGLGTRLEIKRTVAAPSVFIFPPSDE

SEQ ID NO: 8830 - protein, 117 aa, Artificial Sequence
  Description of Artificial Sequence: Synthetic polypeptide
IILFLVATATGSWAQSALTQPRSVSGSLGQSVTISCTGSSSDVGRYNYVSWYQHHPGKAPKLMISDVNKRPSGVPDRFSGSKSGNTASLTISGLQAEDETDYYCCSYAGSYIWVFGG

SEQ ID NO: 8831 - protein, 125 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSDTDFTLTISSLEPEDFAVYYCQQRGIWPLQITFGQGTRLEIKRTVAAPSVFIFPPSDE

SEQ ID NO: 8832 - protein, 119 aa, Artificial Sequence
  Description of Artificial Sequence: Synthetic polypeptide
LSASVGDRVTITCRASQSIDRYLNWYQQKPGKAPKLLIYAASSLHTDVPSRFSGSGAGTYFTLTITSLQPEDFATYYCQQSHSPSFGQESYSITFGQGTRLEIKRTVAAPSVFIFPPSD

SEQ ID NO: 8833 - protein, 115 aa, Artificial Sequence
  Description of Artificial Sequence: Synthetic polypeptide
VTLSLSPGERATLSCRASQTISNNYLAWYQQKPGQAPRLLIYGASSGATGLPDRFSGSGSGTDFTLTISRLEPEDFAVYYCHQYALSPWTFGRGTKVEIKRTVAAPSVFIFPPSD

SEQ ID NO: 8834 - protein, 144 aa, Artificial Sequence
  Description of Artificial Sequence: Synthetic polypeptide
IILFLVATATGVHSDIQMTQSPSSLSASVGDRVTITCRASQSIDRYLNWYQHKPGKAPKLLIYAASNLHTDVPSRFSGSGAGTYFTLTITSLQPEDFATYYCQQSHSPSFGQESYSIAFGQGTRLEIKRTVAAPSVFIFPPSDE

SEQ ID NO: 8835 - protein, 113 aa, Artificial Sequence
  Description of Artificial Sequence: Synthetic polypeptide
QSVLTQPASVSGSPGQSITISCTGTNSDVGYSYVSWFQQHPGKVPKLLIYDVSRRSSGVSNRFSGSRSGNTASLTISGLRAEDEADYYCGSFTTSLTLVFGGGTKLAVLVSPS

SEQ ID NO: 8836 - protein, 124 aa, Artificial Sequence
  Description of Artificial Sequence: Synthetic polypeptide
EIVLTQSPGTLSLSPGERATLSCRASQSVSSRYLAWYQQKPGQAPRLIIYDASSRASGIPDRFSGSGSETDFTLTITRLEPEDFAVYYCQLYGTSPKFTFGQGTKLEIKRTVAAPSVFIFPPSD

SEQ ID NO: 8837 - protein, 114 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSD

SEQ ID NO: 8838 - protein, 114 aa, Artificial Sequence; identical to SEQ ID NO: 8837
  Description of Artificial Sequence: Synthetic polypeptide

SEQ ID NO: 8839 - protein, 120 aa, Artificial Sequence
  Description of Artificial Sequence: Synthetic polypeptide
QSVLTQPASVSGSPGQSITISCTGTSNDVGGQNFVSWYQQHPGTAPQLLIYDVTNRPAGVSSRFSGSKSGNTASLTISGLRTEDEADYYCASFTILNGVDYVFGTGTKVTVLLSPSQPYL

SEQ ID NO: 8840 - protein, 114 aa, Artificial Sequence
  Description of Artificial Sequence: Synthetic polypeptide
DIQMTQSPSSLSARVGDTVTFTCQANGYLNWYQQRRGKAPKLLIYDGSKLERGVPSRFSGRGWGQEYNLTINNLQPEDIATYFCQVYEFAVPGTRLDLKRTVAAPSVFIFPPSD

SEQ ID NO: 8841 - protein, 124 aa, Artificial Sequence
  Description of Artificial Sequence: Synthetic polypeptide
EIVLTQSPATLSVSPGERATLSCRAGQSVSSDLAWYQHKPGQAPRLLIYDASKRATGIPARFSGSGSGTDFTLTISSLEPEDFAVYYCQHRTNWPPSITFGQGTRLEIKRTVAAPSVFIFPPSD

SEQ ID NO: 8842 - protein, 114 aa, Artificial Sequence
  Description of Artificial Sequence: Synthetic polypeptide
DIQMTQSPSSLSARVGDTVTITCQANGYLNWYQQRRGKAPKLLIYDGSKLETGVPSRFTGRRWGQEYNLTINNLQPEDIATYFCQVYEFIVPGTRLDLKRTVAAPSVFIFPPSD

SEQ ID NO: 8843 - protein, 114 aa, Artificial Sequence
  Description of Artificial Sequence: Synthetic polypeptide
DIQMTHSPSSLSASVGDTVTITCQANGYLNWYQQRRGKAPKLLIYDGSKLETGVPSRFTGRRWGQEYNLTINNLQPEDIATYFCQVYEFIVPGTRLDLKRTVAAPSVFIFPPSD

SEQ ID NO: 8844 - protein, 114 aa, Artificial Sequence; identical to SEQ ID NO: 8842
  Description of Artificial Sequence: Synthetic polypeptide

SEQ ID NO: 8845 - protein, 121 aa, Artificial Sequence
  Description of Artificial Sequence: Synthetic polypeptide
DIQMTQSPSSLSASVGDRVTITCQASQGISNSLNWYQQKPGKAPRLLIYGTSTLQRGVPSRFSGSGSGTRFTVTINSLQPEDIATYFCQHNEFFGRGTKVDIKRTVAAPSVFIFPPSDEQL

SEQ ID NO: 8846 - protein, 119 aa, Artificial Sequence
  Description of Artificial Sequence: Synthetic polypeptide
EIVLTQSPGTLSLSPGERATLSCRASQSVSSNYLAWYQQKPGQAPRLLIYGASSRATGIPDRFSGSGSGTDFTLSISRLEPEDFAVYYCQQYGTSSCTFGQGTKLEIKRTVAAPSVFIF

SEQ ID NO: 8847 - protein, 123 aa, Artificial Sequence
  Description of Artificial Sequence: Synthetic polypeptide
EIVLTQSPGTLSLSPGDRAALSCRASETLSGNSLAWYQQKRGQPPRLLIFAASSRATGIPERFSGGGSGTDFTLTITRLEPEDFAVYFCQQYVDAPITFGQGTRLEIKRTVAAPSVFIFPPSD

SEQ ID NO: 8848 - protein, 119 aa, Artificial Sequence
  Description of Artificial Sequence: Synthetic polypeptide
QSVLTQPRSVSGSPGQSVTISCTGTSSDVGGYNYVSWYQQHPGKAPKTMIFDVTKRPSGVPDRFSGSKSGNTASLTISGLQAEDEADYYCSSYAGRNTFYVFGTGTTVTVQVSPSQPPP

SEQ ID NO: 8849 - protein, 123 aa, Artificial Sequence
  Description of Artificial Sequence: Synthetic polypeptide
EIVLTQSPGTLSLSPGERATLSCRASQSVSSNLAWYAQKPGQAPRLIIYGASSRASAIPDRFRGSGSGTDFTLTISRLEPEDFAVYYCQQYDDAPITFGHGTRLEIKRTVAAPSVFIFPPSDE

SEQ ID NO: 8850 - protein, 121 aa, Artificial Sequence
  Description of Artificial Sequence: Synthetic polypeptide
EIVLTQSPGTLSLSPGERATLSCRASQSVSSNNLAWYQQKPGQAPRLLMSGASSRATGIPDRFSGSGSGTDFTLTISRLEPEDFAVYHCQQYGSSPPTFGQGTKVEIKRTVAAPSVFIFPP

SEQ ID NO: 8851 - protein, 105 aa, Artificial Sequence
  Description of Artificial Sequence: Synthetic polypeptide
DIQMTQSPSSLSASVGDKVTITCQTSAGYLNWYQQRRGRAPKLLMYDGSRLVTGVPSRFSGRRWGTQYNLTIGSLQPEDIATYYCQVYEFFGPGTRLDLKSTVAA

SEQ ID NO: 8852 - protein, 120 aa, Artificial Sequence
  Description of Artificial Sequence: Synthetic polypeptide
DIQMTQSPSSLSASIGDRVNITCQASRDTGSALNWYQQKVGRPPRLLISAVSNLGAGVPSRFSGRRSGTQSTLTINTLQPEDIATYFCQHYEFFGPGTKVDIKRTVAAPSVFIFPPSDEQ

SEQ ID NO: 8853 - protein, 114 aa, Artificial Sequence
  Description of Artificial Sequence: Synthetic polypeptide
DIQMTQSPSSLSASVGDTVTFTCQANGYLNWYQQRRGKAPKLLIYDGSRLERGVPSRFSGRRWGQEYNLTINNLQPEDIATYFCQVYEFAVPGTRLDLKRTVAAPSVFIFPPSD

SEQ ID NO: 8854 - protein, 115 aa, Artificial Sequence
  Description of Artificial Sequence: Synthetic polypeptide
DIQMTQSPSSLSASVGDTVTITCQTNKGYLNWYQQRRGRAPKLLMYDGSKLVTGVPSRFSGRRWGTQYNLTIGSLQPEDIATYYCQVYEFFGPGTRLDLKRTVAAPSVFIFPPSD

SEQ ID NO: 8855 - protein, 115 aa, Artificial Sequence
  Description of Artificial Sequence: Synthetic polypeptide
DIQMTQSPSSLSARVGDKVTITYQTSAGYLNWYQQRRGRAPKLLMYDGSRLVTGAPSRFSGRRWGTQYNLTIGSLQPEDIATYYCQVYEFFGPGTRLDLKRTVAAPSVFIFPPSD

SEQ ID NO: 8856 - protein, 114 aa, Artificial Sequence; identical to SEQ ID NO: 8837
  Description of Artificial Sequence: Synthetic polypeptide

SEQ ID NO: 8857 - protein, 206 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8858 - protein, 115 aa, Artificial Sequence
  Description of Artificial Sequence: Synthetic polypeptide
DIQMTQSPSSLSASVGDTVTINCQTNKGYLNWYQQRRGRAPKLLMYDGSKLVTGVPSRFSGRRWGTQYNLTIGSLQPEDIATYYCQVYEFFGPGTRLDLKRTVAAPSVFIFPPSD

SEQ ID NO: 8859 - protein, 115 aa, Artificial Sequence
  Description of Artificial Sequence: Synthetic polypeptide
DIQMTQSPSSLSASVGDTVTITCHTNKGYLNWYQQRRGRAPKLLMFDGSKLVTGVPSRFSGRRWGTQYNLTIGSLQPEDIATYYCQVYEVFGPGTRLDLKRTVAAPSVFIFPPSD

SEQ ID NO: 8860 - protein, 115 aa, Artificial Sequence; identical to SEQ ID NO: 8854
  Description of Artificial Sequence: Synthetic polypeptide

SEQ ID NO: 8861 - protein, 115 aa, Artificial Sequence
  Description of Artificial Sequence: Synthetic polypeptide
DIQMTQSPSSLSASVGDTVTITCQTNKGYLNWYQQRRGRAPKLLMYDGSKLVTGVPSRLSGRRWGTQYNLTIGSLQPEDIATYYCQVYEFFGPGTRLDLKRTVAAPSVFIFPPSD

SEQ ID NO: 8862 - protein, 115 aa, Artificial Sequence
  Description of Artificial Sequence: Synthetic polypeptide
DIQMTQSPSSLSASVGDTVTITCQTNKGYLNWYQQKRGRAPKLLMYDGSKLVTGVPSRLSGRRWGTQYNLTIGSLQPEDIATYYCQVYEFFGPGTRLDLKRTVAAPSVFIFPPSD

SEQ ID NO: 8863 - protein, 115 aa, Artificial Sequence; identical to SEQ ID NO: 8861
  Description of Artificial Sequence: Synthetic polypeptide

SEQ ID NO: 8864 - protein, 115 aa, Artificial Sequence; identical to SEQ ID NO: 8854
  Description of Artificial Sequence: Synthetic polypeptide

SEQ ID NO: 8865 - protein, 115 aa, Artificial Sequence; identical to SEQ ID NO: 8861
  Description of Artificial Sequence: Synthetic polypeptide

SEQ ID NO: 8866 - protein, 114 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQAEDIATYFCQVYEFAVPGTRLDLKRTVAAPSVFIFPPSD

SEQ ID NO: 8867 - protein, 115 aa, Artificial Sequence
  Description of Artificial Sequence: Synthetic polypeptide
DIQMTQSPSSLSARVGDKVTITCQTSAGYLNWYQQRRGRAPKLLMYDGSRLVTGVPSRFSGRRWGTQYNLTIGSLQPEDIATYYCQVYEFFGPGTRLDLKRTVAAPSVFIFPPSD

SEQ ID NO: 8868 - protein, 114 aa, Artificial Sequence
  Description of Artificial Sequence: Synthetic polypeptide
DIQMTQSPSSLSASVGDTVTITCQANGYLNWYQQRRGKAPKLLMYDGSTLERGVPARFSGRRWGQEYNLTINNLQPEDVATYFCQVYEFIVPGTRLDLKRTVAAPSVFIFPPSD

SEQ ID NO: 8869 - protein, 115 aa, Artificial Sequence
  Description of Artificial Sequence: Synthetic polypeptide
DIQMTQSPSSLSASVGDTVTITCQTNKGYLNWYQQRRGRAPKLLMCDGSKLVTGVPSRFSGRRWGTQYNLTIGSLQPEDIATYYCQVYEFFGPGTRLDLKRTVAAPSVFIFPPSD

SEQ ID NO: 8870 - protein, 115 aa, Artificial Sequence
  Description of Artificial Sequence: Synthetic polypeptide
DIQMTQSPSSLSASVGDTVTITCQTTKGYLNWYQQRRGRAPKLLMFDGSKLVTGVPSRFSGRRWGTQYNLTIGSLQPEDLATYYCQVYEFFGPGTRLDLKRTVAAPSVFIFPPSD

SEQ ID NO: 8871 - protein, 115 aa, Artificial Sequence; identical to SEQ ID NO: 8859
  Description of Artificial Sequence: Synthetic polypeptide

SEQ ID NO: 8872 - protein, 114 aa, Artificial Sequence; identical to SEQ ID NO: 8842
  Description of Artificial Sequence: Synthetic polypeptide

SEQ ID NO: 8873 - protein, 104 aa, Artificial Sequence
  Description of Artificial Sequence: Synthetic polypeptide
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLKRTVAA

SEQ ID NO: 8874 - protein, 121 aa, Artificial Sequence
  Description of Artificial Sequence: Synthetic polypeptide
DIQMTQSPSSVSASVGDRVTITCQASRDTDNSLTWYQQKPGRPPKLLIYHVVNLGPGVPSRFSGSASSATQSTLIISDFQPDDVATYFCQNYEFFGPGTKVEIKRTVAAPSVFIFPPSDEQ

SEQ ID NO: 8875 - protein, 114 aa, Artificial Sequence
  Description of Artificial Sequence: Synthetic polypeptide
DIQMTQSPSSLSARVGDTVTFTCQANGYLNWYQQRRGKAPKLLIYDGSKLERGVPSRFSGRRWGQEYNLTINNLQPEDIATYFCQVYEFAVPGTRLDLKRTVAAPSVFIFPPSD

SEQ ID NO: 8876 - protein, 115 aa, Artificial Sequence; identical to SEQ ID NO: 8861
  Description of Artificial Sequence: Synthetic polypeptide

SEQ ID NO: 8877 - protein, 114 aa, Artificial Sequence
  Description of Artificial Sequence: Synthetic polypeptide
DIQMTQSPSSLSARVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSD

SEQ ID NO: 8878 - protein, 113 aa, Artificial Sequence
  Description of Artificial Sequence: Synthetic polypeptide
DIQMTQSPSSLSARVGDTVTFTCQANGYLNWYQQRRGKAPKLLIYDGSKLERGVPSRFSGRRWGQEYNLTINNLQPEDIATYFCQVYEFAVPGTRLDLKRTVAAPSVFIFPSD

SEQ ID NO: 8879 - protein, 108 aa, Artificial Sequence
  Description of Artificial Sequence: Synthetic polypeptide
DIQMTQSPSSLSASVGDTVTINCQTNKGYLNWYQQRRGRAPKLLMYDGSKLVTGVPSRFSGRRWGTQYNLTIGSLQPEDIATYYCQVYEFFGPGTRLDLKRTVAAPSD

SEQ ID NO: 8880 - protein, 115 aa, Artificial Sequence; identical to SEQ ID NO: 8858
  Description of Artificial Sequence: Synthetic polypeptide

SEQ ID NO: 8881 - protein, 114 aa, Artificial Sequence; identical to SEQ ID NO: 8877
  Description of Artificial Sequence: Synthetic polypeptide

SEQ ID NO: 8882 - protein, 115 aa, Artificial Sequence
  Description of Artificial Sequence: Synthetic polypeptide
DIQMTQSPSSLSASVGDKVTITCQTSAGYLNWYQQRRGRAPKLLMYDGSRLVTGVPSRFSGRRWGTQYNLTIGSLQPEDVATYYCQVYEFFGPGTRLDLKRTVAAPSVFIFPPSD

SEQ ID NO: 8883 - protein, 114 aa, Artificial Sequence
  Description of Artificial Sequence: Synthetic polypeptide
DIQMTQSPSSLSARVGDTVTITCQANGYLNWYQQRRGKAPKLLIYDGSKLERGVPSRFSGRRWGQEYNLTINNLQPEDIATYFCQVYEFAVPGTRLDLKRTVAAPSVFIFPPSD

SEQ ID NO: 8884 - protein, 114 aa, Artificial Sequence
  Description of Artificial Sequence: Synthetic polypeptide
DIQMTQSPSSLSASVGDTVTITCQANGYLNWYQQRRGKAPKLLIYDGSKLERGVPSRFSGRRWGQEYNLTINNLQPEDIATYFCQVYEFIVPGTRLDLKRTVAAPSVFIFPPSD

SEQ ID NO: 8885 - protein, 114 aa, Artificial Sequence; identical to SEQ ID NO: 8884
  Description of Artificial Sequence: Synthetic polypeptide

SEQ ID NO: 8886 - protein, 214 aa, Artificial Sequence
  Description of Artificial Sequence: Synthetic polypeptide
DIQMTQSPSTLSASVGDRVTITCRASQSISNWLAWYQQKPGRAPKLLMYKASSLKSGVPSRFSGSGSGTEFTLTISSLQSDDFATYYCQQHDSSPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 8887 - protein, 206 aa, Artificial Sequence
  Description of Artificial Sequence: Synthetic polypeptide
QSALTQPASVSGSPGQSINISCAGRSDRVSWYQQRPNGVPKLLMFDVYRRPSGVSDRFSGSHSGDTAFLTISGLQTEDEADYYCTSHPYAFGAGTKVNVLRQPKANPTVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8888 - protein, 210 aa, Artificial Sequence
  Description of Artificial Sequence: Synthetic polypeptide
EIVLTQSPATLSLSPGETAIISCRTSQYGSLAWYQQRPGQAPRLVIYSGSTRAAGIPDRFSGSRWGADYNLSISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8889 - protein, 233 aa, Artificial Sequence
  Description of Artificial Sequence: Synthetic polypeptide
MAWIPLLLGLLSHCTGSVTSYVSPLSVALGETARISCGRQALGSRAVQWYQHKPGQAPILLIYNNQDRPSGIPERFSGTPDINFGTTATLTISGVEVGDEADYYCHMWDSRSGFSWSFGGATRLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8890 - protein, 211 aa, Artificial Sequence
  Description of Artificial Sequence: Synthetic polypeptide
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8891 - protein, 239 aa, Artificial Sequence
  Description of Artificial Sequence: Synthetic polypeptide
MAWTVLLLGLLSHCTGSLASSMSVSPGETAKISCGKESIGSRAVQWYQQKPGQPPSLIIYNNQDRPAGVPERFSASPDFRPGTTATLTITNVDAEDEADYYCHIYDARGGTNWVFDRGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECSKSLSLSPGK

SEQ ID NO: 8892 - protein, 232 aa, Artificial Sequence
  Description of Artificial Sequence: Synthetic polypeptide
MAWIPLLLGLLSHCTGSDTSLNPLSLAPGATAKIPCGERSRGSRAVQWYQQKPGQAPTLIIYNNQDRPAGVSERFSGNPDVAIGVTATLTISRVEVGDEADYYCHYWDSRSPISWIFGGGTQLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8893 - protein, 230 aa, Artificial Sequence
  Description of Artificial Sequence: Synthetic polypeptide
MAWTFLLLGLLSHCTASVTSDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8894 - protein, 232 aa, Artificial Sequence
  Description of Artificial Sequence: Synthetic polypeptide
MAWIPLLLGLLSHCTGSDTSLNPLSLAPGATAKIPCGERSRGSRAVQWYQQKPGQAPTLIIYNNQDRPAGVSERFSGNPDVAIGVTATLTISRVEVGDEGDYYCHYWDSRSPISWIFAGGTQLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8895 - protein, 230 aa, Artificial Sequence
  Description of Artificial Sequence: Synthetic polypeptide
MAWTVLLLGLLSHCTGAVSTFVSVAPGQTARITCGEESLGSRSVIWYQQRPGQAPSLIIYNNNDRPSGIPDRFSGSPGSTFGTTATLTITSVEAGDEADYYCHIWDSRRPTNWVFGEGTTLIVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8896 - protein, 239 aa, Artificial Sequence
  Description of Artificial Sequence: Synthetic polypeptide
MRLPAQLLGLLMLWVSGSSADTVVTQSPLSLPVTPGEAASMSCSSTQSLRHSNGANYLAWYQHKPGQSPRLLIRLGSQRASGVPDRFSGSGSGTHFTLKISRVEAEDAAIYYCMQGLNRPWTFGKGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8897 - protein, 239 aa, Artificial Sequence
  Description of Artificial Sequence: Synthetic polypeptide
MRLPAQLLGLLMLWVSGSSADTVVTQSPLSLSVTPGEAASMSCTSTQSLRHSNGANYLAWYQHKPGQSPRLLIRLGSQRASGVPDRFSGSGSGTHFTLKISRVEADDAAIYYCMQGLNRPWTFGKGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8898 - protein, 239 aa, Artificial Sequence
  Description of Artificial Sequence: Synthetic polypeptide
MRLPAQLLGLLMLWVSGSSADTVVTQSPLSLPVTPGEAASMSCTSTQSLRHSNGANYLAWYQHKPGQSPRLLIRLGSQRASGVPDRFSGSGSGTHFTLKISRVEPEDAAIYYCMQGLNRPWTFGKGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8899 - protein, 239 aa, Artificial Sequence; identical to SEQ ID NO: 7644
  Description of Artificial Sequence: Synthetic polypeptide

SEQ ID NO: 8900 - protein, 112 aa, Artificial Sequence
  Description of Artificial Sequence: Synthetic polypeptide
EIVLTQSPGTQSLSPGERATLSCRASQSVGNNKLAWYQQRPGQAPRLLIYGASSRPSGVADRFSGSGSGTDFTLTISRLEPEDFAVYYCQQYGQSLSTFGQGTKVEVKLVPR

SEQ ID NO: 8901 - protein, 230 aa, Artificial Sequence
  Description of Artificial Sequence: Synthetic polypeptide
MAWALLLLTLLTQGTGAWAQSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8902 - protein, 230 aa, Artificial Sequence
  Description of Artificial Sequence: Synthetic polypeptide
MAWALLLLTLLTQGTGAWAQSALTQPPSASGSPGQSITISCTGTSNNFVSWYQQHPAKAPKLVIYGVNKRPSGVPDRFSGSKSGNTASLTVSGLQTDDEAVYYCGSLVGNWDVIFGGGTKLTVLGQPMAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8903 - protein, 235 aa, Artificial Sequence
  Description of Artificial Sequence: Synthetic polypeptide
MAWALLLLTLLTQGTGSWAQSALTQPPSASGSLGQSLTISCSGTASDIGSWNFVSWYQQFPGRAPNLIIFEVNRRRSGVPDRFSGSKSGNTASLTVSGLRSEDEAEYFCSSLSGRWDIVFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8904 - protein, 235 aa, Artificial Sequence
  Description of Artificial Sequence: Synthetic polypeptide
MAWALLLLTLLTQGTGSWAQSALTQPPSASGSLGQSLTISCSGTGSDIGSWNFVSWYQQFPGRAPNLIIFEVNRRRSGVPDRFSGSKSGNTASLTVSGLRSEDEAEYFCSSLSGRWDIVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8905 - protein, 230 aa, Artificial Sequence
  Description of Artificial Sequence: Synthetic polypeptide
MAWALLLLTLLTQGTGAWAQSALTQPPSASGSPGQSITISCTGNINNFVSWYQQHPGKAPKLVIYGVNKRPSGVPDRFSGSKSGNAASLTVSGLQTDDEAVYYCGSLAGNWDVVFGGGTKLTVLGQPMAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8906 - protein, 230 aa, Artificial Sequence
  Description of Artificial Sequence: Synthetic polypeptide
MAWALLLLTLLTQGTGAWAQSALTQPPSASGSPGQSISISCTGTSNRFVSWYQQHPGKAPKLVIYGVNKRPSGVPDRFSGSKSGNTASLTVSGLQTDDEAVYYCSSLVGNWDVIFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8907 - protein, 230 aa, Artificial Sequence
  Description of Artificial Sequence: Synthetic polypeptide
MAWALLLLTLLTQGTGAWAQSALTQPPSASGSPGQSITISCTGTSNNFVSWYQQYPGKAPKLVIYEVNKRPSGVPDRFSGSKSGSTASLTVSGLQADDEGVYYCSSLVGNWDVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8908 - protein, 235 aa, Artificial Sequence
  Description of Artificial Sequence: Synthetic polypeptide
MAWALLLLTLLTQGTGSWAQSALTQPPSASGSLGQSVTISCNGTSSDIGGWNFVSWYQQFPGRAPRLIIFEVNKRPSGVPGRFSGSKSGNSASLTVSGLQSDDEGQYFCSSLFGRWDVVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 8909 - protein, 234 aa, Artificial Sequence
  Description of Artificial Sequence: Synthetic polypeptide
METPAQLLFLLLLWLPDSTGEIVMTQSPPTLSVSPGETATLSCRASQNVKNNLAWYQLKPGQAPRLLIFDASSRAGGIPDRFSGSGYGTDFTLTVNSVQSEDFGDYFCQQYEEWPRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8910 - protein, 234 aa, Artificial Sequence
  Description of Artificial Sequence: Synthetic polypeptide
METPAQLLFLLLLWLPDTTGEIVMTQSPDTLSVSPGETVTLSCRASQNINKNLAWYQYKPGQSPRLVIFETYSKIAAFPARFVASGSGTEFTLTINNMQSEDVAVYYCQQYEEWPRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8911 - protein, 234 aa, Artificial Sequence
  Description of Artificial Sequence: Synthetic polypeptide
METPAQLLFLLLLWLPDTTGEIMMTQSPAILSVSPGDRATLSCRASQSVKNNLAWYQKRPGQAPRLLIFDTSSRASGIPARFSGGGSGTEFTLTVNSMQSEDFATYYCQQYEEWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8912 - protein, 239 aa, Artificial Sequence
  Description of Artificial Sequence: Synthetic polypeptide
MRLPAQLLGLLMLWIPELAADIVMTQSPVSLSVTLGQPASMSCKSSQTVRQSDGKTFLYWYRQKAGQSPQLLIYEGSNRFSGVSDRISGSGSGTDFTLRISRVEAEDVGVYFCLQTKDFPLTFGGGTRVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8913 - protein, 239 aa, Artificial Sequence [sequence omitted]

SEQ ID NO: 8914 - protein, 239 aa, Artificial Sequence
  Description of Artificial Sequence: Synthetic polypeptide
MRLPAQLLGLLMLWIPEFAADIVMTQTPVSLSVSLGQAASISCSSSESLGRGDGRTYLHWYRQKPGQTPQLLMYEVSTRFSGVSDRFAGSGSRTQFTLKISRVEAEDVGVYYCMQSRDFPITFGGGTRVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8915 - protein, 241 aa, Artificial Sequence
  Description of Artificial Sequence: Synthetic polypeptide
MRLPAQLLGLLMLWIPEVTADIVMTQTPVSVSVTLGQPASMSCKSSQSVRQSDGKTFLYWYRQICAGQSPQLLIYEASICRFSGVSDRFSGSGSGTDFTLKISRVGAEDVGVYFCMQTKDFPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8916 - protein, 239 aa, Artificial Sequence
  Description of Artificial Sequence: Synthetic polypeptide
MRLPAQLLGLLMLWIPEFIADIVMTQTPLSLSVDPGQPASISCKSSQSLRQSNGKTSLYWYQQKPGQSPQLLIFEVSNRFSGVSDRFVGSGSGTDFTLRISRVEAEDVGFYYCMQSKDFPLTFGGGTKVDLNRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8917 - protein, 239 aa, Artificial Sequence
  Description of Artificial Sequence: Synthetic polypeptide
MRLPAQLLGLLMLWIPEFTADIVLTQSPLFLSVSPGQPASISCKSSQSLRQSNGKTYLYWYVQKSGQSPQPLIQEVSIRFSGVPGRFAGSGSGTDFTLKISRVEAEDVGVYFCMQSKDFPLTFGGGTKVDLNRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8918 - protein, 239 aa, Artificial Sequence
  Description of Artificial Sequence: Synthetic polypeptide
MRLPAQLLGLLMLWIPELTADIVMTQTPVSLSVTLGQPASMSCKSSQSLRQSDGKTFLYWYRQKAGQSPQLLISEASNRFSGVSDRFSGSGSGTDFTLKISRVEAEDVGIYFCMQTKDFPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8919 - protein, 239 aa, Artificial Sequence
  Description of Artificial Sequence: Synthetic polypeptide
MRLPAQLLGLLMLWIPELAADIVMTQSPVSLSVTLGQPASMSCKSSQSVRQSDGKTFLYWYRQKPGQSPQLLIYEGSSRFSGVSDRISGSGSGTDFTLRISRVEAEDAGVYFCLQTKDFPLTFGGGTRVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8920 - protein, 109 aa, Artificial Sequence
  Description of Artificial Sequence: Synthetic polypeptide
SYELTQETGVSVALGRTVTITCRGDSLRSHYASWYQKKPGQAPKLLFYGKNNRPSGIPDRFSGSASGNRASLTISGAQAEDDAEYYCSSRDKSGSRLSVFGGGTKLTVL

SEQ ID NO: 8921 - protein, 109 aa, Artificial Sequence
  Description of Artificial Sequence: Synthetic polypeptide
SYELTQETGVSVALGRTVTITCRGDSLRSHHASWYQKKPGQAPILLFYGKNNRPSGIPDRFSGSASGNRASLTISGAQAEDDAEYYCSSRDKSGSRLSVFGGGTKLIVL

SEQ ID NO: 8922 - protein, 213 aa, Artificial Sequence
  Description of Artificial Sequence: Synthetic polypeptide
EIVLTQSPATLSLSPGERATLSCRASQGLNFVVWYQQKRGQAPRLLIHAPSGRAPGVPDRFSARGSGTEFSLVISSVEPDDFAIYYCQEYSSTPYNFGPGTRVDRKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

SEQ ID NO: 8923 - protein, 123 aa, Artificial Sequence
  Description of Artificial Sequence: Synthetic polypeptide
EIVLTQSPATLSLSPGERATLSCRASQGLNFVVWYQQKGGQAPRLLIHGPTDRAPGVPDRFSARGSGTEFSLVISSVEPDDFALYYCQEYSSTPYNFGPGTRVDRKRTVAAPSVFIFPPSDEQ

SEQ ID NO: 8924 - protein, 213 aa, Artificial Sequence
  Description of Artificial Sequence: Synthetic polypeptide
EIVLTQSPATLSLSPGERATLSCRASQGLNFVVWYQQKGGQAPRLLIHGPTDRAPGVPDRFSARGSGTEFSLVISSVEPDDFALYYCQEYSSTPYNFGPGTRVERKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

SEQ ID NO: 8925 - protein, 123 aa, Artificial Sequence
  Description of Artificial Sequence: Synthetic polypeptide
EIVLTQSPATLSLSPGERATLSCRASQGLNFVVWYQQKRGQAPRLLIHGPSHRAPGVPDRFSARGSGTEFSLVISSVEPDDFAIYYCQEYSSTPYNFGPGTRVDRKRTVAAPSVFIFPPSDEQ

SEQ ID NO: 8926 - protein, 123 aa, Artificial Sequence
  Description of Artificial Sequence: Synthetic polypeptide
EIVLTQSPATLSLSPGERATLSCRASQGVNFVVWYQQKRGQAPRLLIYGPSNRAPGVPDRFSARGSGTEFSLVISSVEPDDFALYYCQEYSSTPYNFGPGTRVDRKRTVAAPSVFIFPPSDEQ

SEQ ID NO: 8927 - protein, 125 aa, Artificial Sequence
  Description of Artificial Sequence: Synthetic polypeptide
EIVMTQSPDTLSVSPGERATLSCRASQSVNSNLAWYQQKPGQAPRLLIYGASTRATAVPARFSGSGSGTEFTLTISSLQSEDSAVYYCQQYYQWLSYTFGQGTKLEIKRTVAAPSVFIFPPSDEQ

SEQ ID NO: 8928 - protein, 125 aa, Artificial Sequence
  Description of Artificial Sequence: Synthetic polypeptide
DIQMTQSPSTLAASIGGTVRVSCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVFIFPPSDEQ

SEQ ID NO: 8929 - protein, 111 aa, Artificial Sequence
  Description of Artificial Sequence: Synthetic polypeptide
EIVLTQSPATLSLSPGERATLSCRASQGVNFVVWYQQKRGQAPRLLIYGNSDRVPGVPDRFSARGSGTEFSLVISSVEPDDFALYYCQEYSSTPYNFGPGTRVDRKRTVAA

SEQ ID NO: 8930 - protein, 126 aa, Artificial Sequence
  Description of Artificial Sequence: Synthetic polypeptide
SEIVLTQSPATLSLSPGERATLSCRASQSINNYLAWYQQKPGQAPRLLIYDASNRATGIPARFSGGGSGTDFTLTISSLEPEDFAVYYCQQRANWRLLTFGGGTKVEIKRTVAAPSVFIFPPSDEQ

SEQ ID NO: 8931 - protein, 126 aa, Artificial Sequence
  Description of Artificial Sequence: Synthetic polypeptide
SEIVMTQSPATLSMSPGERATLSCRASLSVNTNLAWYQQKPGQAPRLLIYGASTRATGIPARFSGSGSGTEFTLTISSLQSEDFALYYCQQYNHWPQTFGQGTKVEIKRTVAAPSVFIFPPSDEQK

SEQ ID NO: 8932 - protein, 124 aa, Artificial Sequence
  Description of Artificial Sequence: Synthetic polypeptide
DIQMTQSPPSLSASVGDRVTITCQASQDINNFLNWYQQKPGKAPRLLIYDASNLESGVSSRFSGSRSGTDFTLTISSLLPEDIATYSCQQYSNLPYTFSQGTKLEIKRTVAAPSVFIFPPSDEQ

SEQ ID NO: 8933 - protein, 123 aa, Artificial Sequence
  Description of Artificial Sequence: Synthetic polypeptide
EIVLTQSPTTLSLSPGERATLSCRASQGVNLVVWYQQKRGQAPRLLIYGPSDRAPGVPDRFSARGSGTEFSLVISSVEPDDFALYYCQEYSSTPYNFGTGTRVDRKRTVAAPSVFIFPPSDEQ

SEQ ID NO: 8934 - protein, 123 aa, Artificial Sequence
  Description of Artificial Sequence: Synthetic polypeptide
EIVLTQSPATLSLSPGERATLSCRASQGLNFVVWYQQKRGQAPRLLIHAPSDRAPGVPDRFSARGSGTDFSLVISSVEPDDFAIYYCQEYSSTPYNFGPGTRVDRKRTVAAPSVFIFPPSDEQ

SEQ ID NO: 8935 - protein, 123 aa, Artificial Sequence
  Description of Artificial Sequence: Synthetic polypeptide
DIQMTQSPSSLSASVGDRVTITCQAGQGIGSSLQWYQQKPGKAPKLLVHGASNLHRGVPSRFSGSGFHTTFSLTISGLQRDDFATYFCAVLEFFGPGTKVEIKRTVAAPSVFIFPPSDEQLKS

SEQ ID NO: 8936 - protein, 112 aa, Artificial Sequence
  Description of Artificial Sequence: Synthetic polypeptide
EIVLTQSPATLSLSPGERATLSCRASQGVNFVVWYQQKRGQAPRLLIYGPSDRAPGVPDRFSARGSGTEFSLVISSVEPDDFALYYCQEYSSTPYNFGTGTRVDRKRTVAAP

SEQ ID NO: 8937 - protein, 220 aa, Artificial Sequence
  Description of Artificial Sequence: Synthetic polypeptide
DIVMSQSPSSLAVSVGEKVTMTCKSSQSLLYSSNQMNYLAWYQQKPGQSPKLLIYWASTRESGVPDRFTGSGSGTDFTLTISSVEAEDLAVYYCQQYHSYPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 8938 - protein, 215 aa, Artificial Sequence
  Description of Artificial Sequence: Synthetic polypeptide
EIVLTQSPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

SEQ ID NO: 8939 - protein, 214 aa, Artificial Sequence
  Description of Artificial Sequence: Synthetic polypeptide
DIQMTQSPSSLSASIGDRVTITCRASQDIANYLNWYQKKSGTPPKLLIFGATNLHHGVSPRFSGSGHGTHFSLTITNVQHEDFANYFCQQSFQTVGSFGQGTWVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8940 - protein, 211 aa, Artificial Sequence
  Description of Artificial Sequence: Synthetic polypeptide
EIVLTQSPGTLSLSPGETATLSCRTSQGILSNQLAWHQQRRGQPPRLLIYGGSNRAPGIPERFTGSGSGTDFVLTIKRLERDDFAVYYCQILEFFGRGTRVEMNRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8941 - protein, 217 aa, Artificial Sequence
  Description of Artificial Sequence: Synthetic polypeptide
QSVLTQPPSVSAAPGQKVTISCSGSSSTIGNNYVSWYRLLPGTAPKLLIYKNDNRPSGIPDRFSGSKSGTSATLGISGLQTGDEADYYCGTWDTSLSGGGVFGTGTKVTVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8942 - protein, 214 aa, Artificial Sequence
  Description of Artificial Sequence: Synthetic polypeptide
QSVLTQPPSVSAAPGQKVTISCSGSNSNIGNKDVSWYQQIPATAPKLLIYENNKRPSGISDRFSGSKSGTSATLAITGLQTGDEADYYCATWDGRVSVIGTGTNVIVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8943 - protein, 217 aa, Artificial Sequence
  Description of Artificial Sequence: Synthetic polypeptide
QSVLTQPPSVSAAPGQKVTISCSGSSSNIGNNFVSWYQQRPGTAPKILIYENNKRPSETPDRFSGSKSGTSATLAITGLQTADEAEYYCATWSASLSSARVFGTGTRITVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8944 - protein, 217 aa, Artificial Sequence
  Description of Artificial Sequence: Synthetic polypeptide
QPVLTQPPSVSAAPGQKVTISCSGSSSNIGNNFVSWYQQRPGTAPSLLIYETNKRPSGIPDRFSGSKSATSATLAITGLQTGDEADYYCATWAASLTSARVFGTGTKVIVSGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8945 - protein, 214 aa, Artificial Sequence
  Description of Artificial Sequence: Synthetic polypeptide
QSALTQPPSVSAAPGQKVTISCSGNIGNNYVSWYQQVPGTAPKLLIYENNKRPSGIPDRFSGSKSGTSATLVITGLQTGDEADFYCGTWGGSLRTGGVLGTGTRVTVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8946 - protein, 214 aa, Artificial Sequence
  Description of Artificial Sequence: Synthetic polypeptide
QSVLTQPPSVSAAPGQKVTISCSGSTSKIGQNSVSWYQQLPGTAPKLLIYENDRRPSGTPDRFSGSKSGTSATLAITGLQTGDEAEYYCETWDGSGGVFGTGTKVTVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8947 - protein, 217 aa, Artificial Sequence
  Description of Artificial Sequence: Synthetic polypeptide
QAVLTQPPSVSAAPGQNVTISCSGSGSNIGNNFVSWYQQRPGTAPKLLIYESNKRPSGIPDRFSGSKSGTSATLAITGLQTGDEAYYYCATWAARLNSARVFGTGTMVTVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8948 - protein, 217 aa, Artificial Sequence
  Description of Artificial Sequence: Synthetic polypeptide
QSALTQPPSVSAAPGQKVTISCSGNSSNIGNNFVSWYQQVPGTAPKLLLYETYRRPSGIPDRFSGSKSGTSATLAITGLQTGDEADYYCTVWGVRKGVGAVFGTGTKVTVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8949 - protein, 217 aa, Artificial Sequence
  Description of Artificial Sequence: Synthetic polypeptide
QSALTQPPSVSAAPGQKVTISCSGNSSNIGNNFVSWYQQLPGTAPKLLIYENNRRPSGIPDRFSGSKSGTSATLAISGLQTGDEADYWCAVWGVRRGAGAVFGAGTKVTVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8950 - protein, 217 aa, Artificial Sequence
  Description of Artificial Sequence: Synthetic polypeptide
QSVLTQPPSVSAAPGQKVTISCSGSSSNIGDNYVSWYQHLPGTAPKLLIYENTRRPSGIPDRFSGSKSGTSATLAITGLQTGDEADYYCGTWDVRPNRGAVFGTGTKVTVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8951 - protein, 213 aa, Artificial Sequence
  Description of Artificial Sequence: Synthetic polypeptide
QSVLTQPPSVSAAPGQNVTISCSGPPSHIEKNDVSWYQRLPGMAPKMVIYESKRRPLGIPVRFSASRSGSSATLVITGLQTADEADYYCGTWDGRMNFGTGTTVSVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8952 - protein, 213 aa, Artificial Sequence
  Description of Artificial Sequence: Synthetic polypeptide
QSVLTQPPSVSTAPGQTVTVSCSGGTSNTGNNFVSWYQHLPGTAPKLLIYENNKRPLGVPDRFSGAKSGTSATLAITGLQTGDEGDYYCATWSGSLNIGTGTKVSVLGQPKADPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8953 - protein, 236 aa, Artificial Sequence
  Description of Artificial Sequence: Synthetic polypeptide
MGWSCIILFLVATATGSWAQSVLTQPPSVSAAPGQKVTISCSGNTSNIGNNFVSWYQQRPGRAPQLLIYETDKRPSGIPDRFSASKSGTSGTLAITGLQTGDEADYYCATWAASLSSARVFGTGTQVIVLGQPKVNPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8954 - protein, 217 aa, Artificial Sequence
  Description of Artificial Sequence: Synthetic polypeptide
QSALTQPPSVSAAPGQKVSISCSGNNSNIGNNFISWFQQFPGTAPKPLIYETYKRHSGIPDRFSGSKSGTSATLAITGLQTGDEADYYCATWGVRQGVGALFGTGTKVTVLGQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8955 - protein, 217 aa, Artificial Sequence
  Description of Artificial Sequence: Synthetic polypeptide
QSVLTQPPSVSAAPGQKVSISCSGNNSNIGNNFISWFQQFPGTAPKPLIYETYRRHSGIPDRFSGSKSGTSATLAITGLQTGDEADYYCATWGVRQGVGALFGTGTKVTVLGQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8956 - protein, 217 aa, Artificial Sequence
  Description of Artificial Sequence: Synthetic polypeptide
QSVLTQPPSVSAAPGQKVTISCSGSSSNIGNNYVSWYQQLPGTAPKLLIYKNNERPSGIPDRFSGSKSGTSATLGITGLQTGDEADYYCGTWDTSLSAGGVFGTGTKVTVLGQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8957 - protein, 217 aa, Artificial Sequence
  Description of Artificial Sequence: Synthetic polypeptide
QSVLTQPPSVSAAPGQKVTISCSGSSSTIGNNYVSWYQLLPGTAPKLLIYKNDKRPSGIPDRFSGSKSGTSATLGITGLQTGDEADYYCGTWDTSLSAGGVFGTGTKVTVLGQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8958 - protein, 217 aa, Artificial Sequence
  Description of Artificial Sequence: Synthetic polypeptide
QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGGVFGTGTKVTVLGQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8959 - protein, 499 aa, Artificial Sequence
  Description of Artificial Sequence: Synthetic polypeptide
TSTLPFSPQVSTPRSKFKRISSEFAATMNRGVPFRHLLLVLQLALLPAATQGKKWLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIWLAFQKASGGGGSGGGGSLEAEAAAKEAAAKEAAAKEAAAKALEGGGGSGGGGSDIVMTQSPDSLAVSPGERATIHCKSSQTLLYSSNNRHSIAWYQQRPGQPPKLLLYWASMRLSGVPDRFSGSGSGTDFTLTINNLQAEDVAIYYCHQYSSHPPTFGHGTRVELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8960 - protein, 479 aa, Artificial Sequence
  Description of Artificial Sequence: Synthetic polypeptide
TSTLPFSPQVSTPRSKFKRISSEFAATMNRGVPFRHLLLVLQLALLPAATQGKKWLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIWLAFQKASLEAEAAAKEAAAKEAAAKEAAAKALEDIVMTQSPDSLAVSPGERATIHCKSSQTLLYSSNNRHSIAWYQQRPGQPPKLLLYWASMRLSGVPDRFSGSGSGTDFTLTINNLQAEDVAIYYCHQYSSHPPTFGHGTRVELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8961 - protein, 239 aa, Artificial Sequence
  Description of Artificial Sequence: Synthetic polypeptide
METPAQLLFLLLLWLPDTTGDIVMTQSPDSLAVSPGERATIHCKSSQTLLYSSNNRHSIAWYQQRPGQPPKLLLYWASMRLSGVPDRFSGSGSGTDFTLTINNLQAEDVAIYYCHQYSSHPPTFGHGTRVELRRTVAAPSVFIFPPSDEQLKSGTASWCLLNNFYPREAKVQWKVDNALQSGNSQESVTEQDSKDSTYSLSSTLTLSKADYEKHKVYACEVTHQGLSSPVTKSFNRGEC

SEQ ID NO: 8962 - protein, 215 aa, Artificial Sequence
  Description of Artificial Sequence: Synthetic polypeptide
QSVLTQPPSASGTPGQRISISCSGTSSNVENNYVYWYQHLPGTAPKLLIYRNDHRSSGIPDRFSASKSGTSASLAISGLRPEDEGDYYCAAWDDSRGGPDWVFGGGTKLTVLAQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPT

SEQ ID NO: 8963 - protein, 212 aa, Artificial Sequence
  Description of Artificial Sequence: Synthetic polypeptide
VVMTQSPSTLSASVGDTITITCRASQSIETWLAWYQQKPGKAPKLLIYKASTLKTGVPSRFSGSGSGTEFTLTISGLQFDDFATYHCQHYAGYSATFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 8964 - protein, 213 aa, Artificial Sequence
  Description of Artificial Sequence: Synthetic polypeptide
AVVMTQSPSTLSASVGDTITITCRASQSIETWLAWYQQKPGKAPKLLIYKASTLKTGVPSRFSGSGSGTEFTLTISGLQFDDFATYHCQHYAGYSATFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 8965 - protein, 215 aa, Artificial Sequence
  Description of Artificial Sequence: Synthetic polypeptide
NSVLTQSPSSLSASVGDRVTITCQASQDISNYLNWYQHKPGKAPKLLIYTASNLETGVPSRFSGGGSGTHFSFTITSLQPEDAATYFCQQYDNLGDLSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8966 - protein, 219 aa, Artificial Sequence
  Description of Artificial Sequence: Synthetic polypeptide
DIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8967 - protein, 219 aa, Artificial Sequence; identical to SEQ ID NO: 8966
  Description of Artificial Sequence: Synthetic polypeptide

SEQ ID NO: 8968 - protein, 102 aa, Artificial Sequence
  Description of Artificial Sequence: Synthetic polypeptide
EIVLTQSPGTLSLSPGETASLSCTAASYGHMTWYQKKPGQPPKLLIFATSKRASGIPDRFSGSQFGKQYTLTITRMEPEDFARYYCQQLEFFGQGTRLEIRR

SEQ ID NO: 8969 - protein, 213 aa, Artificial Sequence
  Description of Artificial Sequence: Synthetic polypeptide
SYELTQPPSVSVSPGQTATITCSGDKVASKNVCWYQVKPGQSPEVVMYENYKRPSGIPDRFSGSKSGSTATLTIRGTQATDEADYYCQVWDSFSTFVFGSGTQVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 8970 - protein, 96 aa, Artificial Sequence
  Description of Artificial Sequence: Synthetic polypeptide
SSELTQDPAVSVALGQTVRITCQGDSLRSYYASWYQQKPGQAPVLVIYGKNNRPSGIPDRFSGSSSGNTASLTISGAQAEDEADYYCNSRDSSGNH

SEQ ID NO: 8971 - protein, 117 aa, Artificial Sequence
  Description of Artificial Sequence: Synthetic polypeptide
DIQMTQSPSTLSASIGDTVRISCRASQSITGNWLAWYHQRPGKAPRLLIYRGSRLLGGVPSRFSGSAAGTDFTLTIANLQAEDFGTFYCQQYDTYPGTFGQGTKVEVKRTVAAPSVF

SEQ ID NO: 8972 - protein, 117 aa, Artificial Sequence
  Description of Artificial Sequence: Synthetic polypeptide
DIQMTQSPSTLSASTGDTVRISCRASQSITGNWVAWYQQRPGKAPRLLIYRGAALLGGVPSRFRGSAAGTDFTLTIGNLQAEDFGTFYCQQYDTYPGTFGQGTKVEVKRTVAAPSVF

SEQ ID NO: 8973 - protein, 117 aa, Artificial Sequence
  Description of Artificial Sequence: Synthetic polypeptide
DIQMTQSPSTLSASIGDTVMISCRASQSITGGWLAWYHQRPGKAPRLLIYRGSKLLGGVPSRFSGSAAGTGFTLTIGNLQAEDFGTFYCQQYDTYPGTFGQGTKVEVKRTVAAPSVF

SEQ ID NO: 8974 - protein, 117 aa, Artificial Sequence
  Description of Artificial Sequence: Synthetic polypeptide
DIQMTQSPSTLSASIGDTVRISCRASQSITGGWLAWYHQRPGKAPRLLIYRGSRLLGGVPSKFSGSAAGTDFTLTIANLQAEDFGTFYCQQYDTYPGTFGQGTKVEVKRTVAAPSVF

SEQ ID NO: 8975 - protein, 117 aa, Artificial Sequence
  Description of Artificial Sequence: Synthetic polypeptide
DIQMTQSPSTLSASIGDTVRISCRASQSITGNWVAWYHQRPGKAPRLLIYRGAALLGGVPSRFSGSAAGTDFTLTIGNLQAEDFGTFYCQQYDTYPGTFGQGTKVEVKRTVAAPSVF

SEQ ID NO: 8976 - protein, 117 aa, Artificial Sequence
  Description of Artificial Sequence: Synthetic polypeptide
DIQMTQSPSTLSASIGDTVRISCRASQSITGGWLAWYHQRPGKAPRLLIYRGSRLVGGVPSRFSGSAAGTDFTLTIGNLQAEDFGTFYCQQYDTYPGTFGQGTKVEVKRTVAAPSVF

SEQ ID NO: 8977 - protein, 117 aa, Artificial Sequence
  Description of Artificial Sequence: Synthetic polypeptide
DIQMTQSPSTLSASIGDTVRISCRASQSITGGWVAWYHQRPGKAPRLLIYRGSRLLGGVPSRFSGSAAGTDFTLTIGNLQAEDFGTFYCQQYDTYPGTFGQGTKVEVKRTVAAPSVF

SEQ ID NO: 8978 - protein, 117 aa, Artificial Sequence
  Description of Artificial Sequence: Synthetic polypeptide
DIQMTQSPSTLSASVGGTVRISCRASQSITGGWLAWYHQRPGKAPRLLIYRGSRLLGGVPSRFSGSAAGTDFTLTIANLQAEDFGTFYCQQYDTYPGTFGQGTKVEVKRTVAAPSVF

SEQ ID NO: 8979 - protein, 117 aa, Artificial Sequence
  Description of Artificial Sequence: Synthetic polypeptide
DIQMTQSPSTLSASVGDTVRISCRASQSITGGWLAWYHQRPGKAPRLLIYRGSRLLGGVPSRFSGSAAGADFTLTIANLQAEDFGTFYCQQYDTYPGTFGQGTKVEVKRTVAAPSVF

SEQ ID NO: 8980 - protein, 117 aa, Artificial Sequence
  Description of Artificial Sequence: Synthetic polypeptide
DIQMTQSPSTLSASVGDTVRISCRASQSITGGWLAWYHQRPGKAPRLLIYRGSRLLGGVPSRFSGSAAGTGFTLTIANLQAEDFGTFYCQQYDTYPGTFGQGTKVEVKRTVAAPSVF

SEQ ID NO: 8981 - protein, 124 aa, Artificial Sequence
  Description of Artificial Sequence: Synthetic polypeptide
PATLAVSPGERATISCKSSQNLLYSANNQHSLAWYQQRPGQPPKLLLYWASTRLSGVPDRFSGSGSGTDFTLTISNLQAEDVAVYYCQQYYSPPPTFGQGTKVEIRRTVAAPSVFIFPPSDEQL

SEQ ID NO: 8982 - protein, 115 aa, Artificial Sequence
  Description of Artificial Sequence: Synthetic polypeptide
TLSASVGDRVTITCRASQSINNYLNWYQQKPGKAPKLLIYAASSLQSGVPSRFSGSGSGTDFTLTISSLQPEDFVTYYCQQTYSNPRMFGQGTKVEIKRTVAAPSVFIFPPSDEQ

SEQ ID NO: 8983 - protein, 118 aa, Artificial Sequence; identical to SEQ ID NO: 8250
  Description of Artificial Sequence: Synthetic polypeptide

SEQ ID NO: 8984 - protein, 126 aa, Artificial Sequence
  Description of Artificial Sequence: Synthetic polypeptide
RGPVTLAVSLGERATITCKSSQSVLVHSNNKNYLSWYQQKPGQPPKLLIYWASTRESGVPERFSGSGSGTDFTLSISSLQAEDVAVYYCHQYFSTPRTFGQGTKVEIKGTVAAPSVFIFPPSDEQL

SEQ ID NO: 8985 - protein, 129 aa, Artificial Sequence
  Description of Artificial Sequence: Synthetic polypeptide
QSALTQTPSVSGAPGQRVTISCSGGPSNVGGNYVYWYQQFPGAAPKLLIRRDDQRPSGVPDRFSGSKSGNSASLAISGLRLDDEAYYFCATYDSGWSIRLFGGGTRLTVLSQPKAAPSVTLFPPSSEEL

SEQ ID NO: 8986 - protein, 125 aa, Artificial Sequence
  Description of Artificial Sequence: Synthetic polypeptide
SQAVVTQPPSVSGAPGQRVTISCSGGPSNVGGNLVYWYKQFPGTAPKLLIRRDDQRPSGVPDRFSGSKSGNSASLAISGLRPDDEAFYFCATYDSHGSIRLFGGGTLLTVLSQPKAAPSVTLFPP

SEQ ID NO: 8987 - protein, 129 aa, Artificial Sequence
  Description of Artificial Sequence: Synthetic polypeptide
QTVVTQPPSASGTPGQRVTISCSGGGSNIGGNLVSWYQHFPGAAPKLLIYRNDQRPSGVPDRFSGSKSGTSASLTISGLRSDDEATYFCAAYDCTLSLRLFGGGTTLNVLSQPKAAPSVTLFPPSSEEL

SEQ ID NO: 8988 - protein, 129 aa, Artificial Sequence
  Description of Artificial Sequence: Synthetic polypeptide
QSALTQPPSVSGTPGQNVTISCSGGGSNVGGNLVSWYQHFPGAAPKLLIHRDNQRPSGVPDRFSVLKSGNSASLAISGPRSDDEAFYFCAVYDSSLSLGLFGGGTKLTVLSQPKAAPSVTLFPPSSEEL

SEQ ID NO: 8989 - protein, 130 aa, Artificial Sequence
  Description of Artificial Sequence: Synthetic polypeptide
QSALTQPPSASGAPGQRVTISCSGGPSNVGGNYVYWYRQFPGTAPTLLILRDDQRPSGVPDRFSASKSGNSASLAISGLRPDDEGFYFCATYDSDGSIRLFGGGTALTVLSQPKAAPSVTLFPPSSEELK

SEQ ID NO: 8990 - protein, 119 aa, Artificial Sequence
  Description of Artificial Sequence: Synthetic polypeptide
NFMLTQAPSASGAPGQRVTISCSGGPSNVGGNYVYWYRQYPGTAPKLLILRDDQRPSGVPDRFSASKSGNSASLAISELRPDDEAFYFCATYDSDGSIRLFGGGTALTVLSQPKAAPSV

SEQ ID NO: 8991 - protein, 124 aa, Artificial Sequence
  Description of Artificial Sequence: Synthetic polypeptide
NFMLTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLFPP

SEQ ID NO: 8992 - protein, 118 aa, Artificial Sequence
  Description of Artificial Sequence: Synthetic polypeptide
QSVLTQPPSASGAPGQRVTISCSGGPSNVGGNYVYWYRQFPGTAPKLLILRDDQRPSGVPDRFSASKSGNSASLAISGLRPDDEAFYFCATYDSDGSIRLFGGGTALTVLSQPKAAPS

SEQ ID NO: 8993 - protein, 120 aa, Artificial Sequence
  Description of Artificial Sequence: Synthetic polypeptide
QLVLTQPPSVSGTPGQNVTISCSGGGSHVGGNLVSWYQHFPGAAPKLLIHRDNQRPSGVPDRFSALKSGNSASLAISGLRSDDEAFYFCAVYDSSLSLGLFGGGTKLTVLSQPKAAPSVT

SEQ ID NO: 8994 - protein, 131 aa, Artificial Sequence
  Description of Artificial Sequence: Synthetic polypeptide
RTVVTQPPSVSGAPGQRVTISCTGSSSNIGAGYDVHWYQQLPGTAPKLLIYGNSNRPSGVPDRFSGSKSGTSASLAITGLQAEDEADYYCQSYDSSLSGSGVFGTGTKVTVLGQPKANPTVTLFPPSSEEL

SEQ ID NO: 8995 - protein, 128 aa, Artificial Sequence
  Description of Artificial Sequence: Synthetic polypeptide
QSALTQPPSASGAPGQRVTISCSGGPSNVGGNYVYWYRQFPGTAPKLLILRDDQRPSGVPDRFSASKSGNSASLAISGLRPDDEALYFCATYDSDGSIRLFGGGTALTVLSQPKAAPSVTLFPPGWEE

SEQ ID NO: 8996 - protein, 124 aa, Artificial Sequence
  Description of Artificial Sequence: Synthetic polypeptide
QPVLTQPPSASGAPGQRVTISCSGGPSNVGGNYVYWYRQFPGTAPNLLILRDDQRPSGVPDRFSASKSGNSASLAITGLRPDDEAFYFCATYDSDGSIRLFGGGTALTVLSQPKAAPSVTLFPP

SEQ ID NO: 8997 - protein, 122 aa, Artificial Sequence
  Description of Artificial Sequence: Synthetic polypeptide
QSALTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLF

SEQ ID NO: 8998 - protein, 129 aa, Artificial Sequence; identical to SEQ ID NO: 8985
  Description of Artificial Sequence: Synthetic polypeptide

SEQ ID NO: 8999 - protein, 123 aa, Artificial Sequence
  Description of Artificial Sequence: Synthetic polypeptide
SEIVLTQSPATLSLSPGESATLSCRASQSLSSSLAWYQQKPGQAPRLLIYDTSDRATGIPARFSGRGSGTDFTLTISSLEPEDFAVYYCQQRSNWAITFGQGTRLEIKRTVAAPSVFIFPPSD

SEQ ID NO: 9000 - protein, 129 aa, Artificial Sequence
  Description of Artificial Sequence: Synthetic polypeptide
QLVLTQPPSVSATPGQTVTISCSGSGSNVGGNHVYWYRQLPGAAPTLVISKTDHRPSRVPDRFSGSKSGNSASLAISGLRPDDEAAYFCATYDTGLSLRLFGGGTRLAVLSQPKAAPSVTLFPPSSEEL

SEQ ID NO: 9001 - protein, 129 aa, Artificial Sequence
  Description of Artificial Sequence: Synthetic polypeptide
QSALTQPPATSGTPGQRVTISCSGGGSNVGGNLVSWYQQFPGAAPKLILHRDGQRPSGVPDRFSASKSGTSASLTISGLRSDDEATYFCAAFDSALSLPLFGGGTKLTVLSQPKAAPSVTLFPPSSEEL

SEQ ID NO: 9002 - protein, 129 aa, Artificial Sequence
  Description of Artificial Sequence: Synthetic polypeptide
QSVLTQVLSVSGTPGQRVIISCSGTSSNVGGNLVSWYQHLPGAAPRLLIHRDDQRPSGVPDRFSGSKSGNSASLVISGLRSDDEADYFCGAYDSTFSLPVFGGGTRLTVLSQPKAAPSVTLFPPSSEEL

SEQ ID NO: 9003 - protein, 128 aa, Artificial Sequence
  Description of Artificial Sequence: Synthetic polypeptide
NFMLTQPPSVSATPGQTVTISCSGSGSNVGGNHVYWYRQLPGAAPTLVISKTDHRPSRVPDRFSGSKSGNSASLAISGLRPDDEAVYFCATYDTGLSLRLFGGGTRLTVLSQPKAAPSVTQFPPSSEE

SEQ ID NO: 9004 - protein, 129 aa, Artificial Sequence
  Description of Artificial Sequence: Synthetic polypeptide
QSALTQPPSVSATPGQTVTISCSGSGSNVGGNHVYWYRQLPGAAPTLLISKTNHRPSQVPDRFSASKSGNSASLAISGLRPDDEADYFCGTYDTSLSLRLFGGGTRLTVLSQPKAAPSVTLFPPSSEEL

SEQ ID NO: 9005 - protein, 129 aa, Artificial Sequence
  Description of Artificial Sequence: Synthetic polypeptide
QSALTQPPSASGTPGQRVTISCSGGGSNIGGNLVSWYQHFPGTAPKLLIYRNDQRPSGVPDRFSGSKSGTSASLTISGLRSDDEATYFCAAYDSSLSLRLFGGGTTLNVLSQPKAAPSVTLFPPSSEEL

SEQ ID NO: 9006 - protein, 129 aa, Artificial Sequence
  Description of Artificial Sequence: Synthetic polypeptide
QSALTQPPSVSGTPGQNVTISCSGGGSDVGGNLVSWYQHFPGAAPKLLIHRDNQRPSGVPDRFSALKSGNSASLAISGLRSDDEAFYFCAVYDSSLSLGLFGGGTKLTVLSQPKAAPSVTLFPPSSEEL

SEQ ID NO: 9007 - protein, 129 aa, Artificial Sequence
  Description of Artificial Sequence: Synthetic polypeptide
QAVVTQPPSVSATPGQTVTISCSGSGSNVGGNHVYWYRQLPGAAPTLLISKTNRRPSQVPDRFSGSKSGNSASLAISGLRPDDEADYFCATYDTDLSLRLFGGGTRLTVLSQPKAAPSVTLFPPSSEEL

SEQ ID NO: 9008 - protein, 120 aa, Artificial Sequence
  Description of Artificial Sequence: Synthetic polypeptide
QSALTQPPAASGAPGQRVTISCSGGGSNVGGNLVSWYQQFPGAAPKLILHRDGQRPSGVPDRFSASKSGTSASLTISGLRSDDEATYFCAAYDSAVSLPVFGGGTKLTVLSQPKAAPLVT

SEQ ID NO: 9009 - protein, 128 aa, Artificial Sequence
  Description of Artificial Sequence: Synthetic polypeptide
NFMLTQPPSASGTPGQRVTISCSGGGSNIGGNLVSWYQHFPGAAPKLLIYRNDQRPSGVPDRFSGSKSGTSASLAISGLRSDDKATYFCAAYDSTLSLRLFGGGTTLTVLSQPKAAPSVTLFPPSSEE

SEQ ID NO: 9010 - protein, 127 aa, Artificial Sequence
  Description of Artificial Sequence: Synthetic polypeptide
QSVLTQVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQPKAAPSVTLFPPSSE

SEQ ID NO: 9011 - protein, 129 aa, Artificial Sequence
  Description of Artificial Sequence: Synthetic polypeptide
QSALTQPPSVSATPGQTVTISCSGSGSNVGGNHVYWYRQLPGAAPTLLISKTDHRPSRVPDRFSASKSGNSASLAISGLRPDDEAIYFCATYDTGLSLRLFGGGTRLTVLSQPKAAPSVTLFPPSSEEL

SEQ ID NO: 9012 - protein, 129 aa, Artificial Sequence
  Description of Artificial Sequence: Synthetic polypeptide
QSALTRTPSVSGAPGQRVTISCSGGPSNVGGNYVYWYQQFPGAAPKLLIRRDDQRPSGVPDRFSGSKSGNSASLAISGLRLDDEAYYFCATYDSGWSIRLFGGGTRLTVLSQPKAAPSVTLFPPSSEEL

SEQ ID NO: 9013 - protein, 115 aa, Artificial Sequence
  Description of Artificial Sequence: Synthetic polypeptide
QSALTQAPSASGTPGQRVTISCSGGGSNIGGNLVSWYQHFPGAAPKLLIYRNDQRPSGVPDRFSASKSGTSASLAISGLRSDDEATYFCAAYDSTLSLRLFGGGTTLAVLSQPKA

SEQ ID NO: 9014 - protein, 129 aa, Artificial Sequence
  Description of Artificial Sequence: Synthetic polypeptide
NFMLTQPPSVSGAPGQRVTISCSGGPSNVGGNLVYWYKQFPGTAPKLLIRRDDQRPSGVPDRFSGSKSGNSASLAISGLRPDDEAFYFCATYDSHGSIRLFGGGTLLTVLSQPKAAPSVTLFPPSSEEL

SEQ ID NO: 9015 - protein, 129 aa, Artificial Sequence
  Description of Artificial Sequence: Synthetic polypeptide
QLVLTQPPSVSGAPGQRVTISCSGGPSNVGGNLVYWYKQFPGTAPKLLIRRDDQRPSGVPDRFSGSKSGNSASLTISGLRPDDEAFYFCATYDSQGSTRLFGGGTVLTVLSQPKAAPSVTLFPPSSEEL

SEQ ID NO: 9016 - protein, 128 aa, Artificial Sequence
  Description of Artificial Sequence: Synthetic polypeptide
QSALTQPPSVSGAPGQRVTISCSGGPSNVGGNYVYWYRQFPGTAPKLLILRDDQRPSGVPDRFSASKSGNSASLAISGLRPDDEAFYFCATYDSQGSFRVFGGGTALTVLSQPKAAPSVTLYPPSSEE

SEQ ID NO: 9017 - protein, 129 aa, Artificial Sequence
  Description of Artificial Sequence: Synthetic polypeptide
NFMLTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLFPPSSEEL

SEQ ID NO: 9018 - protein, 123 aa, Artificial Sequence
  Description of Artificial Sequence: Synthetic polypeptide
QVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQPKAAPSVTLYAPSSEE

SEQ ID NO: 9019 - protein, 117 aa, Artificial Sequence
  Description of Artificial Sequence: Synthetic polypeptide
PVTLSASVGDRVTITCRASEDISKYLNWYQHKPGKAPKLLIYTASSLETGVPSRFSGSGSGTDFSLTISSLQPDDFATYYCQQSYTSSVTFGQGTRVEVKRTVAAPSVFIFPPSDEQ

SEQ ID NO: 9020 - protein, 212 aa, Artificial Sequence
  Description of Artificial Sequence: Synthetic polypeptide
QMTQSPSSVSASVGDRVTITCRASQGISSWLAWYQQKPGKAPKLLINAASSLQSGVPSRFSGSGSGTDFTLTISSLQPEDFATYYCQQANSFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQLLSSPVTKSFNRGEC

SEQ ID NO: 9021 - protein, 214 aa, Artificial Sequence
  Description of Artificial Sequence: Synthetic polypeptide
TLTQSPTTLSASPGERVILSCRASQSVSSSHLAWYQQRPGQTPRLLIYSSSSRAAGIPDRFSGSGSGTDFTLTISRLEPEDFAVYYCQNQGFSPRFFFGPGTTVDMKRTVAAPSVFIFPPSDEQLKSGTASVVCLLNNFYPREAKVQWKVDNALQSGNSQESVTEQDSKDSTYSLSSTLTLSKADYEKHKVYACEVTHQLLSSPVTKSFNRGEC

SEQ ID NO: 9022 - protein, 212 aa, Artificial Sequence
  Description of Artificial Sequence: Synthetic polypeptide
QMTQSPSFLSASVGDRVSITCRASQDIQKFLAWYQLTPGDAPKLLMYSASTLQSGVPSRFSGSGSGTEFTLTISGLQPEDFATYYCQHLKRYPYTFGQGTKLEISRTVAAPSVFIFPPSDEQLKSGTASVVCLLNNFYPREAKVQWKVDNALQSGNSQESVTEQDNKDSTYSLSSTLTLSKADYEKHKVYACEVTHQLLSSPVTKSFNRGEC

SEQ ID NO: 9023 - protein, 210 aa, Artificial Sequence
  Description of Artificial Sequence: Synthetic polypeptide
TQSPGTLSLSPGERATLSCRASHSVSRAYLAWYQQKPGQAPRLLIYGTSSRATGIPDRFSGSGSGTDFTLTISRLEPEDFAVYYCQQYGGSPWFGQGTKVELKRTVAAPSVFIFPPSDEQLKSGTASVVCLLNNFYPREAKVQWKVDNALQSGNSQESVTEQDSKDSTYSLSSTLTLSKADYEKHKVYACEVTHQLLSSPVTKSFNRGEC

SEQ ID NO: 9024 - protein, 235 aa, Artificial Sequence
  Description of Artificial Sequence: Synthetic polypeptide
QVQLVQSGAEVKKPGESLKISCKVSGYNFASEWIGWVRQMPGKGLEWMGIIYPGDSDTKYSPSFQGQVIISADKSINTAYLQWSSLKASDTAIYYCARQNHYGSGSYFYRTAYYYAMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 9025 - protein, 213 aa, Artificial Sequence
  Description of Artificial Sequence: Synthetic polypeptide
DIQLTQSPSSLSASLGDKVTITCRASQHIKKYLNWYQQKPGKAPKLLIYGALNLQSGVPSRFSGRGSGTDFTLTISSLQPEDFATYYCQQSYSTPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 9026 - protein, 214 aa, Artificial Sequence
  Description of Artificial Sequence: Synthetic polypeptide
DIQMTQSPSTLSASVGDRVTITCRASQTISSWLAWYQQKSGTAPKLLIYKASSIVSGVPSRFSGSGSGTEFTLTITSLQPDDFATYYCQQYNSSPETFGQGTKVEIKRTVAAPSVFIFPPSDEQLKSGTASVVCLLNNFYPREAKVQWKVDNALQSGNSQESVTEQDSKDSTYSLSSTLTLSKADYEKHKLYACEVTHQGLSSPVTKSFNRGEC

SEQ ID NO: 9027 - protein, 219 aa, Artificial Sequence; identical to SEQ ID NO: 8966
  Description of Artificial Sequence: Synthetic polypeptide

SEQ ID NO: 9028 - protein, 216 aa, Artificial Sequence
  Description of Artificial Sequence: Synthetic polypeptide
QSALTQPASVSGSPGQTITISCQGTSSDVGGFDSVSWYQQSPGKAPKVMVFDVSHRPSGISNRFSGSKSGNTASLTISGLHIEDEGDYFCSSLTDRSHRIFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 9029 - protein, 216 aa, Artificial Sequence; identical to SEQ ID NO: 8775
  Description of Artificial Sequence: Synthetic polypeptide

SEQ ID NO: 9030 - protein, 215 aa, Artificial Sequence
  Description of Artificial Sequence: Synthetic polypeptide
SYVLTQPPSVSVAPGQTARITCGGNNIGSKSVHWYQQKPGQAPVLVVYDDSDRPSGIPERFSGSNSGNTATLTISRVEAGDEADYYCQVWDSSSDHPWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9031 - protein, 211 aa, Artificial Sequence
  Description of Artificial Sequence: Synthetic polypeptide
TFVSVAPGQTARITCGEESLGSRSVIWYQQRPGQAPSLIIYNNNDRPSGIPDRFSGSPGSTFGTTATLTITSVEAGDEADYYCHIWDSRRPTNWVFGEGTTLIVLSQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 9032 - protein, 211 aa, Artificial Sequence
  Description of Artificial Sequence: Synthetic polypeptide
SSMSVSPGETAKISCGKESIGSRAVQWYQQKPGQPPSLIIYNNQDRPAGVPERFSASPDFRPGTTATLTITNVDAEDEADYYCHIYDARGGTNWVFDRGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 9033 - protein, 214 aa, Artificial Sequence
  Description of Artificial Sequence: Synthetic polypeptide
SYVSPLSVALGETARISCGRQALGSRAVQWYQHKPGQAPILLIYNNQDRPSGIPERFSGTPDINFGTTATLTISGVEVGDEADYYCHMWDSRSGFSWSFGGATRLTVLSQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 9034 - protein, 216 aa, Artificial Sequence
  Description of Artificial Sequence: Synthetic polypeptide
QSALTQPPSASGSLGQSVTISCNGTSSDIGGWNFVSWYQQFPGRAPRLIIFEVNKRPSGVPGRFSGSKSGNSASLTVSGLQSDDEGQYFCSSLFGRWDVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9035 - protein, 214 aa, Artificial Sequence
  Description of Artificial Sequence: Synthetic polypeptide
EIVMTQSPDTLSVSPGETVTLSCRASQNINKNLAWYQYKPGQSPRLVIFETYSKIAAFPARFVASGSGTEFTLTINNMQSEDVAVYYCQQYEEWPRTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9036 - protein, 215 aa, Artificial Sequence
  Description of Artificial Sequence: Synthetic polypeptide
ELTQSPSSLSASVGDRVTITCRASQGIRDDLGWYQQKPGKAPKRLIYAASNLQSGVPSRFSGGGSGTEFTLTISSLQPEDFATYYCLQHNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNKGKVLIL

SEQ ID NO: 9037 - protein, 220 aa, Artificial Sequence
  Description of Artificial Sequence: Synthetic polypeptide
DIQMTQRPDSLSASVGDRVTMSCKSSQSLLNSGDQKNYLTWYQQKPGQPPKLLIYWASTGESGVPDRFSGSGSGTDFTFTISSLQPEDIATYYCQNDYSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9038 - protein, 208 aa, Artificial Sequence [sequence omitted]

SEQ ID NO: 9039 - protein, 104 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKR

SEQ ID NO: 9040 - protein, 101 aa, Artificial Sequence
  Description of Artificial Sequence: Synthetic polypeptide
VLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 9041 - protein, 100 aa, Artificial Sequence
  Description of Artificial Sequence: Synthetic polypeptide
VLTQSPGTLSLSPGETAIISCRTSQYGSLAWYQQRPGQAPRLVIYSGSTRAAGIPDRFSGSRWGPDYNLTISNLESGDFGVYYCQQYEDFGQGTKVQVDI

SEQ ID NO: 9042 - protein, 101 aa, Artificial Sequence
  Description of Artificial Sequence: Synthetic polypeptide
VLTQSPGTLSLSPGETAIISCRTSQYGSLAWYQQRPGQAPRLVIYSGSTRAAGIPDRFSGSRWGPDYNLTISNLESGDFGVYYCQQYEHFGQGTKVQVDIK

SEQ ID NO: 9043 - protein, 101 aa, Artificial Sequence
  Description of Artificial Sequence: Synthetic polypeptide
VLTQSPGTLSLSPGETAIISCRTSQYGSLAWYQQRPGQAPRLVIYSGSTRAAGIPDRFSGSRWGPDYNLTISNLESGDFGVYYCQQYEKFGQGTKVQVDIK

SEQ ID NO: 9044 - protein, 101 aa, Artificial Sequence
  Description of Artificial Sequence: Synthetic polypeptide
VLTQSPGTLSLSPGETAIISCRTSQYGSLAWYQQRPGQAPRLVIYSGSTRAAGIPDRFSGSRWGPDYNLTISNLESGDFGVYYCQQYESFGQGTKVQVDIK

SEQ ID NO: 9045 - protein, 101 aa, Artificial Sequence
  Description of Artificial Sequence: Synthetic polypeptide
ELTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 9046 - protein, 101 aa, Artificial Sequence
  Description of Artificial Sequence: Synthetic polypeptide
ELTQSPGTLSLSPGETAIISCRTSQYGSLAWYQQRPGQAPRLVIYSGSTRAAGIPDRFSGSRWGPDYNLTISNLESGDFGVYYCQQYEHFGQGTKVQVDIK

SEQ ID NO: 9047 - protein, 101 aa, Artificial Sequence
  Description of Artificial Sequence: Synthetic polypeptide
ELTQSPGTLSLSPGETAIISCRTSQYGSLAWYQQRPGQAPRLVIYSGSTRAAGIPDRFSGSRWGPDYNLTISNLESGDFGVYYCQQYESFGQGTKVQVDIK

SEQ ID NO: 9048 - protein, 101 aa, Artificial Sequence
  Description of Artificial Sequence: Synthetic polypeptide
KLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 9049 - protein, 100 aa, Artificial Sequence
  Description of Artificial Sequence: Synthetic polypeptide
SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDI

SEQ ID NO: 9050 - protein, 103 aa, Artificial Sequence
  Description of Artificial Sequence: Synthetic polypeptide
EIVLTQSPGILSLSPGETATLFCKASQGGNAMTWYQKRRGQVPRLLIYDTSRRASGVPDRFVGSGSGTDFFLTINKLDREDFAVYYCQQFEFFGLGSELEVHR

SEQ ID NO: 9051 - protein, 103 aa, Artificial Sequence
  Description of Artificial Sequence: Synthetic polypeptide
EIVLTQSPGTLSLSPGETATISCRTSQYGSLAWYQQRPGQAPRLVIYSGSTRAAGIPDRFSGSRSGPDYTLTISNLESGDFGVYYCQQYEFFGQGTKVQQDNK

SEQ ID NO: 9052 - protein, 101 aa, Artificial Sequence
  Description of Artificial Sequence: Synthetic polypeptide
SLTQSPGTLSLSPGETATISCRTSQYGSLAWYQQRPGQAPRLVIYSGSTRAAGIPDRFSGSRSGPDYTLTISNLESGDFGVYYCQQYEFFGQGTKVQQDNK

SEQ ID NO: 9053 - protein, 103 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRSGPDYTLTISNLESGDFGVYYCQQYEFFGQGTKVQVDIK

SEQ ID NO: 9054 - protein, 103 aa, Artificial Sequence
  Description of Artificial Sequence: Synthetic polypeptide
EIVLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIK

SEQ ID NO: 9055 - protein, 103 aa, Artificial Sequence
  Description of Artificial Sequence: Synthetic polypeptide
EIVLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQQDNK

SEQ ID NO: 9056 - protein, 103 aa, Artificial Sequence
  Description of Artificial Sequence: Synthetic polypeptide
EIVLTQSPGTLSLSPGETAEISCRTSQYGSLAWYQQRPGQAPRLVIYSGSTRAAGIPDRFKGEREGPEYRLRISNLESGDFGVYYCQQYEFFGQGTKVQQDNK

SEQ ID NO: 9057 - protein, 101 aa, Artificial Sequence
  Description of Artificial Sequence: Synthetic polypeptide
SLTQSPGTLSLSPGETAIISCRTSQYGSLAWYQQRPGQAPRLVIYSGSTRAAGIPDRFSGSRSGPDYTLTISNLESGDFGVYYCQQYEFFGQGTKVQVDIK

SEQ ID NO: 9058 - protein, 101 aa, Artificial Sequence
  Description of Artificial Sequence: Synthetic polypeptide
ELTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIK

SEQ ID NO: 9059 - protein, 101 aa, Artificial Sequence
  Description of Artificial Sequence: Synthetic polypeptide
SLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQVDIK

SEQ ID NO: 9060 - protein, 101 aa, Artificial Sequence
  Description of Artificial Sequence: Synthetic polypeptide
SLTQSPGTLSLSPGETAQISCRTSQYGSLAWYQQRPGQAPRLVIYSGSTRAAGIPDRFSGSRNGPDYTLTISNLESGDFGVYYCQQYEFFGQGTKVQQDNK

SEQ ID NO: 9061 - protein, 101 aa, Artificial Sequence
  Description of Artificial Sequence: Synthetic polypeptide
SLTQSPGTLSLSPGETAEISCRTSQYGSLAWYQQRPGQAPRLVIYSGSTRAAGIPDRFKGEREGPEYRLRISNLESGDFGVYYCQQYEFFGQGTKVQQDNK

SEQ ID NO: 9062 - protein, 104 aa, Artificial Sequence
  Description of Artificial Sequence: Synthetic polypeptide
EIVLTQSPGTLSLSPGETAIISCRTSQYGSLAWYQQRPGQAPRLVIYSGSTRAAGIPDRFSGSRWGPDYNLTIRNLESGDFGLYYCQQYEFFGQGTKVQVDIKR

SEQ ID NO: 9063 - protein, 102 aa, Artificial Sequence
  Description of Artificial Sequence: Synthetic polypeptide
EIVLTQSPGILSLSPGETATLFCKASQGGNAMTWYQKRRGQVPRLLIYDTSRRASGVPDRFVGSGSGTDFFLTINKLDREDFAVYYCQQFEFFGLGSELEVH

SEQ ID NO: 9064 - protein, 104 aa, Artificial Sequence; identical to SEQ ID NO: 9039
  Description of Artificial Sequence: Synthetic polypeptide

SEQ ID NO: 9065 - protein, 209 aa, Artificial Sequence
  Description of Artificial Sequence: Synthetic polypeptide
EIVLTQSPGTLSVSPGERATLFCKASQGGNSLSWYQKRRGQPPRLLIYDTSRRASGIPDRFVGSGSGTDFSLTITKVDRDDFALYFCQQFEFFGLGTALEINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9066 - protein, 211 aa, Artificial Sequence
  Description of Artificial Sequence: Synthetic polypeptide
YIGLTQSPGTLSVSPGERATLSCRPSQAISKSHLAWYSQKSGQPPRLLLTGTYERASGVPDRFVGSGSGTNYTLTIASVEAEDFAVYFCQCFEGFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9067 - protein, 210 aa, Artificial Sequence
  Description of Artificial Sequence: Synthetic polypeptide
EIVMTQSPVTVSVSRGGTATLSCRASQGVGSDVAWYQHKPGQTPRLLIYGASTRASGVPERFSGSGFHVDFTLSISGLQPEDVAIYYCQQYETFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9068 - protein, 103 aa, Artificial Sequence
  Description of Artificial Sequence: Synthetic polypeptide
DIQMTQSPSSLSASLGDRVTITCQASRGIGKDLNWYQQKPGKAPKLLVSDASILEGGVPSRFSGSGFHQNFSLTISSLQPEDVATYFCQQYETFGQGTKVDIK

SEQ ID NO: 9069 - protein, 210 aa, Artificial Sequence
  Description of Artificial Sequence: Synthetic polypeptide
DIQMTQSPSSLSASLGDRVTITCQASRGIGKDLNWYQQKAGKAPKLLVSDASTLEGGVPSRFSGSGFHQNFSLTISSLQAEDVATYFCQQYETFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9070 - protein, 103 aa, Artificial Sequence
  Description of Artificial Sequence: Synthetic polypeptide
DIQMTQSPSSLSASLGDRVTITCQASRGIGKDLNWYQQKPGRAPKLLVSDASILEGGVPTRFSGSGFHQNFSLTISSLQAEDVATYFCQQYETFGQGTKVDIK

SEQ ID NO: 9071 - protein, 103 aa, Artificial Sequence
  Description of Artificial Sequence: Synthetic polypeptide
DIQMTQSPSSLSASLGDRVTITCQASRGIGKDLNWYQQKRGRAPRLLVSDASVLEGGVPSRFSGSGFHQNFSLTISTLQPEDVATYFCQQYETFGQGTKVDIK

SEQ ID NO: 9072 - protein, 103 aa, Artificial Sequence
  Description of Artificial Sequence: Synthetic polypeptide
DIQMTQSPSSLSASLGDRVTITCQASRGIGKDLNWYQQKAGKAPKLLVSDASILEGGVPSRFSGSGFHQNFSLTISSLQPEDVATYFCQQYETFGQGTKVDIK

SEQ ID NO: 9073 - protein, 100 aa, Artificial Sequence
  Description of Artificial Sequence: Synthetic polypeptide
EIVLTQSPGTLSLSPGETASLSCTAASYGHMTWYQKKPGQPPKLLIFATSKRASGIPDRFSGSQFGKQYTLTITRMEPEDFARYYCQQLEFFGQGTRLEI

SEQ ID NO: 9074 - protein, 101 aa, Artificial Sequence
  Description of Artificial Sequence: Synthetic polypeptide
EIVLTQSPGTLSLSPGETASLSCTAASYGHMTWYQKKPGQPPKLLIFATSKRASGIPDRFSGSQFGKQYTLTITRMEPEDFAGYYCQQVEFFGQGTRLEIR

SEQ ID NO: 9075 - protein, 204 aa, Artificial Sequence
  Description of Artificial Sequence: Synthetic polypeptide
QSALTQPPSVSGSPGQSITLSCTGASTSVAWYQQYADKAPRLIVFDGNKRPSDISSRFSGSQSGGTASLTISGLQSEDEAYYHCNAFEFFGGGTKLTVLSQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTEC

SEQ ID NO: 9076 - protein, 237 aa, Artificial Sequence
  Description of Artificial Sequence: Synthetic polypeptide
MKKTAIAIAVALAGFATVAQAAELVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIKRTVAAPSVFIFPPSDEQLKSGTASVVCLLNNFYPREAKVQWKVDNALQSGNSQESVTEHDSRDSTYSLGSTLTLSKADYEKHKVYACEVTHQGLSSPVTKSFNRGEC

SEQ ID NO: 9077 - protein, 237 aa, Artificial Sequence; identical to SEQ ID NO: 9076
  Description of Artificial Sequence: Synthetic polypeptide

SEQ ID NO: 9078 - protein, 212 aa, Artificial Sequence
  Description of Artificial Sequence: Synthetic polypeptide
ELTQSPATLSLSPGERATLSCRASQSVGRNLGWYQQKPGQAPRLLIYDASNRATGIPARFSGSGSGTDFTLTISSLEPEDFAVYYCQARLLLPQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9079 - protein, 210 aa, Artificial Sequence
  Description of Artificial Sequence: Synthetic polypeptide
DIQMTQSPSSLAVSVGGRVTITCRASQGIGSDLHWYQQKRGRPPKILIHHASAREEGVPSRFGGSGSHTPFIFTINDLQLDDVATYYCQVIESFGQGTRLDINRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9080 - protein, 215 aa, Artificial Sequence; identical to SEQ ID NO: 8938
  Description of Artificial Sequence: Synthetic polypeptide

SEQ ID NO: 9081 - protein, 236 aa, Artificial Sequence [sequence omitted]

SEQ ID NO: 9082 - protein, 106 aa, Artificial Sequence
  Description of Artificial Sequence: Synthetic polypeptide
ELTQSPSSLSASVGDRVTITCRTSQGISNYLAWYQQKPGKVPKLLIYGASTLQSGGPSRFSGSGSGTDFTLTINSLQPEDVATYSCQNYDSAPWTFGQGTKVDIKR

SEQ ID NO: 9083 - protein, 108 aa, Artificial Sequence [sequence omitted]

SEQ ID NO: 9084 - protein, 107 aa, Artificial Sequence
  Description of Artificial Sequence: Synthetic polypeptide
ELTQSPSSLSASVGDRVTITCRASQNINNYLNWYQQKPGEAPKLLIHTAFNLQSGVPSRFSGTASGTEFTLTIRSLQPEDFATYYCQQSYSTPYTFGQGTKVEIKRT

SEQ ID NO: 9085 - protein, 107 aa, Artificial Sequence
  Description of Artificial Sequence: Synthetic polypeptide
ELTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIKRT

SEQ ID NO: 9086 - protein, 107 aa, Artificial Sequence
  Description of Artificial Sequence: Synthetic polypeptide
ELTQSPSSLSASVGDRVTITCRASQSISSYLNWYQQKPGKAPKLLIYAASSLQSGVPSRFSGSGSGTDFTLTISSLQPEDFATYYCQQSYSTPQTFGQGTKLEIKRT

SEQ ID NO: 9087 - protein, 107 aa, Artificial Sequence
  Description of Artificial Sequence: Synthetic polypeptide
ELTQSPSSLSASVGDRVTITCQASQDIRNYLNWYQQKPGKAPKLLIYDASNSETGVPSRFSGSGSGRDFTFTISSLQPEDVATYYCQQHQNVPLTFGGGTKVEIKRT

SEQ ID NO: 9088 - protein, 108 aa, Artificial Sequence [sequence omitted]

SEQ ID NO: 9089 - protein, 107 aa, Artificial Sequence
  Description of Artificial Sequence: Synthetic polypeptide
ELTQSPGTLSLSPGERATFSCRSSHNIRSRRVAWYQHKPGQAPRLVIHGVSNRATGISDRFSGSGSGTDFTLTITRLEPEDFALYYCQVYGASSYTFGQGTKLDFKR

SEQ ID NO: 9090 - protein, 107 aa, Artificial Sequence
  Description of Artificial Sequence: Synthetic polypeptide
ELTQSPDTLSLNTGERATLSCRASHRIGSRRLAWYQHRRGQAPRLLIYGVSNRAGGVPDRFSGSGSGTDFTLTISRLEPEDFAIYYCQTYGGSSYTFGQGTKVDIKR

SEQ ID NO: 9091 - protein, 107 aa, Artificial Sequence
  Description of Artificial Sequence: Synthetic polypeptide
ELTQSPGTLSSTPGERAILSCKTSHNIWSRRLAWYQVKSGLPPRLLIHGVSRRAGGIPDRFSGSGSARDFTLTISRLEPADFAVYYCQTYGGSSYSFGQGTKLDFNR

SEQ ID NO: 9092 - protein, 107 aa, Artificial Sequence
  Description of Artificial Sequence: Synthetic polypeptide
ELTQSPGTLSLNPGERAVLSCRTSRNIWSRRLAWYQVRRGQAPRLLIHGVSKRAGGVPDRFSGSGSARDFTLTISRLEPEDFAVYFCQTYGGSSYTFGQGNKLDIRR

SEQ ID NO: 9093 - protein, 125 aa, Artificial Sequence
  Description of Artificial Sequence: Synthetic polypeptide
QVKLLEQSGAEVKKPGASVKVSCQASGYRFSNFVLHWARQAPGHRPEWMGWINPANGVTEISPKFQDRVSLTGDTSASTVYLELRNLRFADTAVYYCARVGEWTWDDSPQDNYYMDVWGRGTTVT

SEQ ID NO: 9094 - protein, 124 aa, Artificial Sequence
  Description of Artificial Sequence: Synthetic polypeptide
QVKLLEQSGAEVKKPGASVKVSCQASGYRFSNFVLHWARQAPGHRPEWMGWINPANGVTEIPPKFQDRVSLTRDTSAGTVYLELTNLRFADTAVYYCARVGEWTWDDSPQDNYYMDVWGKGTTV

SEQ ID NO: 9095 - protein, 109 aa, Artificial Sequence
  Description of Artificial Sequence: Synthetic polypeptide
MAELTQSPGTLSLSPGERVIVSCRASQSVSSNYLAWYQQKPGQAPRLLIYGASNRATGIPDRFSGSGSGTDFTLTISRLEPEDFAVYYCQQYGSSGTFGQGTKVEIKRT

SEQ ID NO: 9096 - protein, 112 aa, Artificial Sequence
  Description of Artificial Sequence: Synthetic polypeptide
MAELTQSPGTLSLSPGERATFSCRSSHSIHTRRVAWYQHKPGQAPRLVIHGVSNRASGISDRFSGSGSGTDFTLTITRVEPEDFALYYCQVYGASSYTFGQGTKLERKRTVV

SEQ ID NO: 9097 - protein, 111 aa, Artificial Sequence
  Description of Artificial Sequence: Synthetic polypeptide
MAELTQSPGTLSLSPGERATLSCRASQSVSNGYLAWYQQKPGQAPRLLIYGASTRATDIPDRFSGSGSGADFTLAISRLEPEDFAVYYCQQYAGSHTFGQGTKLEIKRTVA

SEQ ID NO: 9098 - protein, 111 aa, Artificial Sequence
  Description of Artificial Sequence: Synthetic polypeptide
MAELTQSPSSLSASVGDRVTITCRPSQGIGRFFNWYQQKPGKAPNLLIYAADILQSGVPSRFSGSGSGTDFTLTISSLQPEDFATYYCQQSYSTPYTFGQGTRLDIKRTVA

SEQ ID NO: 9099 - protein, 112 aa, Artificial Sequence
  Description of Artificial Sequence: Synthetic polypeptide
MAELTQSPSSLSASVGDRVTITCRASQGVSSSYLAWYQQKPGQAPRLVIFGAYSRATGIPDRFSGSGSGTDFTLTISRLEPEDFAVYYCQQYGSSPITFGPGTKVDIKRTVA

SEQ ID NO: 9100 - protein, 108 aa, Artificial Sequence [sequence omitted]

SEQ ID NO: 9101 - protein, 108 aa, Artificial Sequence
  Description of Artificial Sequence: Synthetic polypeptide
ELTQSPGTLSLTPGERATLSCRTSHSIRSRRLAWYQVKGGQAPRLLIYGVSNRAGGIPDRFSGSGSGTDFTLTISRLEPEDFAVYYCQQYGSSRYTFGQGTKLEIKRT

SEQ ID NO: 9102 - protein, 107 aa, Artificial Sequence
  Description of Artificial Sequence: Synthetic polypeptide
ELTQAPGTLSLSPGERATFSCRSSHSIRSRRVRWYQHKPGQAPRLVIHGVSNRASGISDRFSGSGSGTDFTLTITRVEPEDFALYYCQVYGASSYTFGQGTKLERKR

SEQ ID NO: 9103 - protein, 108 aa, Artificial Sequence
  Description of Artificial Sequence: Synthetic polypeptide
ELTQAPGTLSLSPGDRATFSCRSSHNIRSRRVAWYQHKPGQAPRLVIHGVSNRASGISDRFSGSGSGTDFTLTITRLEPEDFALYYCQVYGASSYTFGQGTKLDFKRT

SEQ ID NO: 9104 - protein, 132 aa, Artificial Sequence
  Description of Artificial Sequence: Synthetic polypeptide
QVQLQESGPGLVKPSETLSLTCSVSNGSVSGRFWSWIRQSPGRGLEWIGYFSDTEKSNYNPSLRSRLTLSVDASKNQLSLKLNSVTAADSATYYCARTQQGKRIYGVVSFGEFFHYYYMDAWGKGTAVTVSS

SEQ ID NO: 9105 - protein, 132 aa, Artificial Sequence
  Description of Artificial Sequence: Synthetic polypeptide
QVQLQESGPGLVKPSETLSVTCSVSGDSMNNSYWTWIRQSPGKGLEWIGYISKSESANYNPSLNSRVVISRDTSKNQLSLKLNSVTPADTAVYYCATARHGQRIYGVVSFGEFFTYYSMDVWGKGTTVTVSS

SEQ ID NO: 9106 - protein, 132 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSS

SEQ ID NO: 9107 - protein, 132 aa, Artificial Sequence
  Description of Artificial Sequence: Synthetic polypeptide
QVQLQESGPGLVKPPETLSLTCSVSGASINDAYWSWIRQSPGKRPEWVGYVHHSGDTNYNPSLKRRVSFSLDTAKNEVSLKLVDLTAADSAIYFCARALHGKRIYGIVALGELFTYFYMDVWGKGTTVTVSS

SEQ ID NO: 9108 - protein, 132 aa, Artificial Sequence
  Description of Artificial Sequence: Synthetic polypeptide
QVQLQESGPGLVKPPETLSLTCSVSGASINDAYWSWIRQSPGKRPEWVGYVHHSGDTNYNPSLKRRVTFSLDTAKNEVSLKLVDLTAADSAVYFCARALHGKRIYGIVALGELFTYFYMDVWGKGTTVTVSS

SEQ ID NO: 9109 - protein, 132 aa, Artificial Sequence
  Description of Artificial Sequence: Synthetic polypeptide
QVQLVESGPGLVTPSETLSLTCTVSNGSVSGRFWSWIRQSPGRGLEWIGYFSDTDRSEYSPSLRSRLTLSLDASRNQLSLKLKSVTAADSATYYCARAQQGKRIYGIVSFGEFFYYYYMDAWGKGTAVTVSS

SEQ ID NO: 9110 - protein, 132 aa, Artificial Sequence
  Description of Artificial Sequence: Synthetic polypeptide
QVQLQESGPGLVKPSETLSVTCSVSGDSMNNYYWTWIRQSPGKGLEWIGYISDRESATYNPSLNSRVVISRDTSTNQLSLKLNSVTPADTAVYYCATARRGQRIYGVVSFGEFFYYYSMDVWGRGTTVTVSS

SEQ ID NO: 9111 - protein, 132 aa, Artificial Sequence
  Description of Artificial Sequence: Synthetic polypeptide
QVQLQESGPGLVKPLETLSLTCNVSGAFIADHYWSWIRLPLGKGPEWIGYVHDSGDINYNPSLKNRVHLSLDKSTNQVSLKLMAVTAGDSALYYCATTKHGRRIYGVVAFGEWFTYFYMDVWGRGTTVTVSS

SEQ ID NO: 9112 - protein, 132 aa, Artificial Sequence
  Description of Artificial Sequence: Synthetic polypeptide
QVHLQESGPGLVKPSETLSLTCNVSGTLVRDNYWSWMRQPLGKQPEWIGYVHDSGDTNYNPSLKSRVHLSLDKSNNLVSLRLTAVTAADSATYYCATTKHGRRIYGIVAFNEWFTYFYMDVWGKGTTVTVSS

SEQ ID NO: 9113 - protein, 132 aa, Artificial Sequence
  Description of Artificial Sequence: Synthetic polypeptide
QVQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSS

SEQ ID NO: 9114 - protein, 132 aa, Artificial Sequence
  Description of Artificial Sequence: Synthetic polypeptide
QVQLQESGPGLVKPPETLSLTCSVSGASVNDAYWSWIRQSPGKRPEWVGYVHHSGDTNYNPSLKRRVTFSLDTAKNEVSLKLVALTAADSAVYFCARALHGKRIYGIVALGELFTYFYMDVWGKGTTVTVSS

SEQ ID NO: 9115 - protein, 132 aa, Artificial Sequence
  Description of Artificial Sequence: Synthetic polypeptide
QVQLQESGPGLVKPSETLSVTCSVSGDSMNNYYWTWIRQSPGKGLEWIGYISDRASATYNPSLNSRVVISRDTSKNQLSLKLNSVTPADTAVYYCATARRGQRIYGVVSFGEFFYYYSMDVWGKGTTVTVSS

SEQ ID NO: 9116 - protein, 132 aa, Artificial Sequence
  Description of Artificial Sequence: Synthetic polypeptide
  MOD_RES (27)..(27): Any amino acid
  MOD_RES (29)..(30): Any amino acid
  MOD_RES (32)..(32): Any amino acid
  MOD_RES (68)..(69): Any amino acid
  MOD_RES (83)..(84): Any amino acid
  MOD_RES (92)..(92): Any amino acid
  MOD_RES (99)..(99): Any amino acid
  MOD_RES (102)..(102): Any amino acid
  MOD_RES (113)..(113): Any amino acid
QVQLQESGPGLVKPSETLSLTCSVSGXSXXDXYWSWIRQSPGKGLEWIGYVHDSGDTNYNPSLKSRVXXSLDTSKNQVSLKLXXVTAADSAXYYCARAXHGXRIYGIVAFGEXFTYFYMDVWGKGTTVTVSS

SEQ ID NO: 9117 - protein, 107 aa, Artificial Sequence [sequence omitted]

SEQ ID NO: 9118 - protein, 215 aa, Artificial Sequence
  Description of Artificial Sequence: Synthetic polypeptide
EIVLTQSPATLSVSPGERATLSCRASQNVHPRYFAWYQQKRGQSPRLLIHSGSTRAAGIADRFSGGGSGMHFTLTITRVEPEDFAVYFCQQYGGSPYTFGQGTRVELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9119 - protein, 217 aa, Artificial Sequence
  Description of Artificial Sequence: Synthetic polypeptide
QSVLTQPPSVSAAPGQKVTISCSGSSSNIGKNYVSWYQQLPGAAPKLLIFDDTQRPSGIPDRFSGSKSGTSATLAITGLQTGDEADYYCGTWDSSLSTGQLFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTMAHAECS

SEQ ID NO: 9120 - protein, 216 aa, Artificial Sequence
  Description of Artificial Sequence: Synthetic polypeptide
DTVMTQSPATLSVSPGERVTLSCRASQIINTNLAWYQKRPGQAPRLLIYAASARATGIPARFSGSGSGTEFTLTISGLQSEDSAVYYCQQYKHWPPYTFGRGTKLEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECS

SEQ ID NO: 9121 - protein, 209 aa, Artificial Sequence
  Description of Artificial Sequence: Synthetic polypeptide
SYELTQPPSVSVSPGQTASITCSGDILGDKYVSWYQQKSGQSPLLVIYEDTKRPSGIPDRFSGSKSGNTATLTISGTQAMDEADYYCQAWDSTLGVVFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAP

SEQ ID NO: 9122 - protein, 213 aa, Artificial Sequence
  Description of Artificial Sequence: Synthetic polypeptide
SYELTQPPSVSVSPGQTARITCSGDALPEKYAYWYQQKSGQAPVLIIYEDSKRPSGIPERFSGSRSGTMATLTISGAQVDDEADYYCYSTNSGGTFFVFGTGTKVTVLGQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 9123 - protein, 215 aa, Artificial Sequence
  Description of Artificial Sequence: Synthetic polypeptide
AEVKKPGSSVKVSCKASGGTFSNYAINWVRQAPGQGLEWMGGIIPIFNIAHYAQRFQGRVSITADESTSTAYMELSSLRSEDTAVFYCASPYPNDYNDYAPEEGMSWYFDLWGRGTLVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTK

SEQ ID NO: 9124 - protein, 109 aa, Artificial Sequence
  Description of Artificial Sequence: Synthetic polypeptide
SYELTQPPSVSVSPGQTARITCSGDALPNQYVYWYQQRPGQAPVVVLYKDTERPSGIPERFSGSSSGTTVTLTISGVQAEDEADYYCQSADNSGAYPLFFGGGTKLTVL

SEQ ID NO: 9125 - protein, 109 aa, Artificial Sequence
  Description of Artificial Sequence: Synthetic polypeptide
DIQLTQSPSSLSASVGDRVTITCRASESINTYLNWYQQRPGKAPKLLIYAASTLQTGVPSRFSGSGSGTLFTLTISSLQPEDLATYYCQQSFSTLPYTLGRGTKVEIKG

SEQ ID NO: 9126 - protein, 111 aa, Artificial Sequence
  Description of Artificial Sequence: Synthetic polypeptide
QSVLTQPPSASGTPGQRVTISCSGSGSNIGSNTVNWYQQFPGTAPKLLIYNNNQRPSGVPDRFSGSKSGTSASLAISGLQSADEADYYCATWDDSLDGWVFGGGTKLTVLG

SEQ ID NO: 9127 - protein, 110 aa, Artificial Sequence
  Description of Artificial Sequence: Synthetic polypeptide
QSALTQPASVSGSLGQSVTISCTGPSSVCCSHKSISWYQWPPGRAPTLLIFEDSERSWGISDRFSGYKSYWSASLTISNLRPEDETTYYCCSYTHNSGCVFGTGTNVSVL

SEQ ID NO: 9128 - protein, 110 aa, Artificial Sequence
  Description of Artificial Sequence: Synthetic polypeptide
QSALTQPASVSGSLGQSVTISCTGPSSVCCSHKSISWYQWPPGRAPTLLIFEDSERSWGISDRFSGYKSYWSASLTISNLRPEDETTYFCCSYTHNSGCVFGTGTKVSVL

SEQ ID NO: 9129 - protein, 110 aa, Artificial Sequence
  Description of Artificial Sequence: Synthetic polypeptide
QSALTQPASVSGSLGQSVTISCTGPSSVCCSHKSISWYQWPPGRAPTLLIFEDSERSWGISDRFSGYKSYWSASLTISNLRPEDETTYYCCSYTHNSGCVFGTGTKVSVL

SEQ ID NO: 9130 - protein, 110 aa, Artificial Sequence
  Description of Artificial Sequence: Synthetic polypeptide
QPVLTQPASVSGSLGQSVTISCTGPSSVCCSHKSISWYRWPPGRAPTLIIYEDNKRFSEISPRFSGYKSYWSAYLTISDLRPEDETTYYCCSYTHNSGCVFATGTKVSVL

SEQ ID NO: 9131 - protein, 110 aa, Artificial Sequence
  Description of Artificial Sequence: Synthetic polypeptide
QSVLTQSASVSGSLGQSVTISCTGPNSVCCSHKSISWYQWPPGRAPTLIIYEDNERAPGISPRFSGYKSYWSAYLTISDLRPEDETTYYCCSYTHNSGCVFGTGTKVSVL

SEQ ID NO: 9132 - protein, 108 aa, Artificial Sequence
  Description of Artificial Sequence: Synthetic polypeptide
DIQLTQSPSSLSASVGDRVTITCRASQSISNYLNWYQQKPGKAPKLLIYAASSLQSGVPSRFSGSGSGTDFTLTISSLQPEDFATFYCQQSHSIPYTFGQGTKLEIKR

SEQ ID NO: 9133 - protein, 111 aa, Artificial Sequence; identical to SEQ ID NO: 9126
  Description of Artificial Sequence: Synthetic polypeptide

SEQ ID NO: 9134 - protein, 110 aa, Artificial Sequence
  Description of Artificial Sequence: Synthetic polypeptide
QSALTQPASVSGSLGQSVTISCTGPNSVCCSHKSISWYQWPPGRAPTLIIYEDNEKAPGISHRFSGYKSYWSAYLTISDLRPEDETTYYCCSYTHNSGCVFGTGTKVSVL

SEQ ID NO: 9135 - protein, 108 aa, Artificial Sequence
  Description of Artificial Sequence: Synthetic polypeptide
EIVLTQSPATLSVSPGEGATLSCRASQSISSNLAWYQQKPGQAPRLLIYGASTGATGIPARFSGSGSGTDFTLTISRLEPEDFAIYYCQQYGSLPITFGQGTRLEIKR

SEQ ID NO: 9136 - protein, 110 aa, Artificial Sequence
  Description of Artificial Sequence: Synthetic polypeptide
QSALTQPASVSGSLGQSVTISCTGPNSACCSHKSISWHQWPPGRAPTLIIYEDNEKAPGISHRFSGYKSYWSAYLTISDLRPEDETTYYCCSYTHNSGCVFGTGTKVSVL

SEQ ID NO: 9137 - protein, 110 aa, Artificial Sequence
  Description of Artificial Sequence: Synthetic polypeptide
QSALTQPASVSGSLGQSVTISCTGPNSVCCSHKSISWYQWPPGRAPTLLIFEDSERSWGISDRFSGYKSYWSASLTISNLRPEDETTYYCCSYTHNSGCVFGTGTKVSVL

SEQ ID NO: 9138 - protein, 111 aa, Artificial Sequence
  Description of Artificial Sequence: Synthetic polypeptide
DIVLTQSPASLAVSLGQRATISCKAGQSVDYDGDSYMNWYQQKPGQPPKLLIYVASNLESGIPARFSGSGSGTDFTLNIHPVEEEDAATYYCQQSYKDPLTFGAGTKLELK

SEQ ID NO: 9139 - protein, 111 aa, Artificial Sequence
  Description of Artificial Sequence: Synthetic polypeptide
DIVLTQSPASLAVSLGQRATITCKAGQSVDYDGDSYMNWYQQKPGQPPKLLIYVASNLESGIPARFSGSGSGTDFTLNIHPVEENDAATYYCQQSYKDPLTFGQGTKLEIK

SEQ ID NO: 9140 - protein, 111 aa, Artificial Sequence
  Description of Artificial Sequence: Synthetic polypeptide
DIVLTQSPASLAVSPGQRATITCKAGQSVDYDGDSYMNWYQQKPGQPPKLLIYVASNLESGIPSRFSGSGSGTDFTLTINPVEENDTATYYCQQSYKDPLTFGQGTKVEIK

SEQ ID NO: 9141 - protein, 111 aa, Artificial Sequence
  Description of Artificial Sequence: Synthetic polypeptide
DIVLTQSPASLAVSPGQRATITCKAGQSVDYDGDSYMNWYQQKPGQPPKLLIYVASNLESGIPSRFSGSGSGTDFTLTINPVEENDTATYYCQQSYKDPLAFGPGTKVEIK

SEQ ID NO: 9142 - protein, 236 aa, Artificial Sequence
  Description of Artificial Sequence: Synthetic polypeptide
MEFGLSWVFLVAIIIGVQCQVEIVLTQAPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERKRTAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9143 - protein, 107 aa, Artificial Sequence
  Description of Artificial Sequence: Synthetic polypeptide
DIQMTQSPSSLSASVGDRVTITCKASQDVGADVAWYQQKPGKAPKLLISWASTRHTGVPSRFSGSGSGTDFTFTISSLQPEDIATYYCQQYSSFPLTFGQGTKVEIK

SEQ ID NO: 9144 - protein, 111 aa, Artificial Sequence
  Description of Artificial Sequence: Synthetic polypeptide
DIQMTQSPSSLSASVGDRVTITCKASQSVDYDGDSYMNWYQQKPGKAPKLLIYAASNLESGVPSRFSGSGSGTDFTFTISSLQPEDIATYYCQQSNEDPWTFGQGTKVEIK

SEQ ID NO: 9145 - protein, 110 aa, Artificial Sequence
  Description of Artificial Sequence: Synthetic polypeptide
EIVLSQSPATLSLSPGERATLSCRASQSVTNSLAWYQQKPGQAPRLLIYDASNRATGIPARFSGSGSGTDFTLTISSLEPEDFAVYYCQQRSNWPPEVTFGPGTKVDIKR

SEQ ID NO: 9146 - protein, 206 aa, Artificial Sequence
  Description of Artificial Sequence: Synthetic polypeptide
QSVLTQPPSASGTPGQRDTISCSGSSPNIGSNSAHWHQRVPGTAPKLLIYMNIERPSGVPDRISGSKSDSSASLAISGLRSGDEVDYFCELWGGPKLTVPGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9147 - protein, 109 aa, Artificial Sequence
  Description of Artificial Sequence: Synthetic polypeptide
QSVLTQPPSVSAAPGQKVTISCSGTNSNLGDKFVSWYQQLPGTAPRLLIYDNDKRPSGIPDRFSGSKSGASATLAITGLQTGDEADYYCGTWDNSLSALFGGGTKLTVL

SEQ ID NO: 9148 - protein, 114 aa, Artificial Sequence
  Description of Artificial Sequence: Synthetic polypeptide
DVVMTQSPEFLAVSLGERATLECKSSHSLLYAPYDKDALVWYQQKPGQPPKLLLDWASSRRSGVSDRFSATSASGRYFTLTISNFRADDVATYYCQQTRWTPPTFGGGTKVDLN

SEQ ID NO: 9149 - protein, 108 aa, Artificial Sequence
  Description of Artificial Sequence: Synthetic polypeptide
DIQMTQSPSSLSPSVGDRVTITCQASQDIRNHLNWYQQKPGKAPKLLIYDASNLATGVPSRFSGSGSGTDFTFTISSLQPEDLATYYCQHYDDLPRITFGQGTRLEIK

SEQ ID NO: 9150 - protein, 106 aa, Artificial Sequence
  Description of Artificial Sequence: Synthetic polypeptide
TAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9151 - protein, 114 aa, Artificial Sequence
  Description of Artificial Sequence: Synthetic polypeptide
ELTQPSSLSASPGASASLTCTLRSGINVGTYRIYWYQQKPGSPPQFLLRYKSDSDKEQGSGVPRRFSGSKDASANAGILLISGLQSEDEADYYCMIWHSGAWVFGGGTKLTVLS

SEQ ID NO: 9152 - protein, 96 aa, Artificial Sequence; identical to SEQ ID NO: 8669
  Description of Artificial Sequence: Synthetic polypeptide

SEQ ID NO: 9153 - protein, 120 aa, Artificial Sequence; identical to SEQ ID NO: 8670
  Description of Artificial Sequence: Synthetic polypeptide

SEQ ID NO: 9154 - protein, 111 aa, Artificial Sequence
  Description of Artificial Sequence: Synthetic polypeptide
DIQMTQSPSSLSASVGDRVTITCRASESVDSYGNSFMHWYQQTPGKAPKLLIYVASNLESGVPSRFSGSGSGTDYTFTISSLQPEDIATYYCQQNNEDPLTFGQGTKLQIT

SEQ ID NO: 9155 - protein, 111 aa, Artificial Sequence; identical to SEQ ID NO: 8672
  Description of Artificial Sequence: Synthetic polypeptide

SEQ ID NO: 9156 - protein, 105 aa, Artificial Sequence
  Description of Artificial Sequence: Synthetic polypeptide
QSALTQPPSASGSPGQSITISCNGTATNFVSWYQQFPDKAPKLIIFGVDKRPPGVPDRFSGSRSGTTASLTVSRLQTDDEAVYYCGSLVGNWDVIFGGGTTLTVL

SEQ ID NO: 9157 - protein, 105 aa, Artificial Sequence
  Description of Artificial Sequence: Synthetic polypeptide
QSALTQPPSASGSPGQSISISCTGTSNRFVSWYQQHPGKAPKLVIYGVNKRPSGVPDRFSGSKSGNTASLTVSGLQTDDEAVYYCSSLVGNWDVIFGGGTKLTVL

SEQ ID NO: 9158 - protein, 110 aa, Artificial Sequence
  Description of Artificial Sequence: Synthetic polypeptide
QSALTQPPSASGSLGQSLTISCSGTGSDIGSWNFVSWYQQFPGRAPNLIIFEVNRRRSGVPDRFSGSKSGNTASLTVSGLRSEDEAEYFCSSLSGRWDIVFGGGTKVTVL

SEQ ID NO: 9159 - protein, 107 aa, Artificial Sequence
  Description of Artificial Sequence: Synthetic polypeptide
EIVMTQSPPTLSVSPGETATLSCRASQNVKNNLAWYQLKPGQAPRLLIFDASSRAGGIPDRFSGSGYGTDFTLTVNSVQSEDFGDYFCQQYEEWPRTFGQGTKVDIK

SEQ ID NO: 9160 - protein, 107 aa, Artificial Sequence
  Description of Artificial Sequence: Synthetic polypeptide
EIMMTQSPAILSVSPGDRATLSCRASQSVKNNLAWYQKRPGQAPRLLIFDTSSRASGIPARFSGGGSGTEFTLTVNSMQSEDFATYYCQQYEEWPRTFGQGTKVEIK

SEQ ID NO: 9161 - protein, 112 aa, Artificial Sequence
  Description of Artificial Sequence: Synthetic polypeptide
DTVVTQSPLSLPVTPGEAASMSCSSTQSLRHSNGANYLAWYQHKPGQSPRLLIRLGSQRASGVPDRFSGSGSGTHFTLKISRVEAEDAAIYYCMQGLNRPWTFGKGTKLEIK

SEQ ID NO: 9162 - protein, 112 aa, Artificial Sequence; identical to SEQ ID NO: 9161
  Description of Artificial Sequence: Synthetic polypeptide

SEQ ID NO: 9163 - protein, 112 aa, Artificial Sequence
  Description of Artificial Sequence: Synthetic polypeptide
DTVVTQSPLSLPVTPGEAASMSCTSTQSLRHSNGANYLAWYQHKPGQSPRLLIRLGSQRASGVPDRFSGSGSGTHFTLKISRVEPEDAAIYYCMQGLNRPWTFGKGTKLEIK

SEQ ID NO: 9164 - protein, 112 aa, Artificial Sequence
  Description of Artificial Sequence: Synthetic polypeptide
DTVVTQSPLSLSVTPGEAASMSCTSTQSLRHSNGANYLAWYQHKPGQSPRLLIRLGSQRASGVPDRFSGSGSGTHFTLKISRVEADDAAIYYCMQGLNRPWTFGKGTKLEIK

SEQ ID NO: 9165 - protein, 112 aa, Artificial Sequence
  Description of Artificial Sequence: Synthetic polypeptide
DIVMTQTPLSLSVTPGQPASISCKSSESLRQSNGKTSLYWYRQKPGQSPQLLVFEVSNRFSGVSDRFVGSGSGTDFTLRISRVEAEDVGFYYCMQSKDFPLTFGGGTKVDLK

SEQ ID NO: 9166 - protein, 112 aa, Artificial Sequence
  Description of Artificial Sequence: Synthetic polypeptide
DIVMTQTPLSLSVDPGQPASISCKSSQSLRQSNGKTSLYWYQQKPGQSPQLLIFEVSNRFSGVSDRFVGSGSGTDFTLRISRVEAEDVGFYYCMQSKDFPLTFGGGTKVDLN

SEQ ID NO: 9167 - protein, 112 aa, Artificial Sequence
  Description of Artificial Sequence: Synthetic polypeptide
DIVLTQSPLFLSVSPGQPASISCKSSQSLRQSNGKTYLYWYVQKSGQSPQPLIQEVSIRFSGVPGRFAGSGSGTDFTLKISRVEAEDVGVYFCMQSKDFPLTFGGGTKVDLN

SEQ ID NO: 9168 - protein, 112 aa, Artificial Sequence
  Description of Artificial Sequence: Synthetic polypeptide
DIVMTQTPVSLSVSLGQAASISCSSSESLGRGDGRTYLHWYRQKPGQTPQLLMYEVSTRFSGVSDRFAGSGSRTQFTLKISRVEAEDVGVYYCMQSRDFPITFGGGTRVDLK

SEQ ID NO: 9169 - protein, 112 aa, Artificial Sequence
  Description of Artificial Sequence: Synthetic polypeptide
DIVMTQSPVSLSVTLGQPASMSCKSSQSVRQSDGKTFLYWYRQKPGQSPQLLIYEGSSRFSGVSDRISGSGSGTDFTLRISRVEAEDAGVYFCLQTKDFPLTFGGGTRVDLK

SEQ ID NO: 9170 - protein, 112 aa, Artificial Sequence
  Description of Artificial Sequence: Synthetic polypeptide
DIVMTQSPVSLSVTLGQPASMSCKSSQTVRQSDGKTFLYWYRQKAGQSPQLLIYEGSNRFSGVSDRISGSGSGTDFTLRISRVEAEDVGVYFCLQTKDFPLTFGGGTRVDIK

SEQ ID NO: 9171 - protein, 112 aa, Artificial Sequence
  Description of Artificial Sequence: Synthetic polypeptide
DIVMTQTPVSLSVTLGQPASMSCKSSQSLRQSDGKTFLYWYRQKAGQSPQLLISEASNRFSGVSDRFSGSGSGTDFTLKISRVEAEDVGIYFCMQTKDFPLTFGGGTKVDLK

SEQ ID NO: 9172 - protein, 112 aa, Artificial Sequence
  Description of Artificial Sequence: Synthetic polypeptide
DIVMTQTPVSVSVTLGQPASMSCKSSQSVRQSDGKTFLYWYRQKAGQSPQLLIYEASKRFSGVSDRFSGSGSGTDFTLKISRVGAEDVGVYFCMQTKDFPLTFGGGTKVDLK

SEQ ID NO: 9173 - protein, 128 aa, Artificial Sequence
  Description of Artificial Sequence: Synthetic polypeptide
METPAQLLFLLLLWLPDTTGEIVLTQSPGTLSLSAGERATLSCRASQSVSSRYLAWYQQKPGQAPRLLIYGASSRATGIPDRFSGSGSGTDFTLTISRVEPEDFAVYYCQQYDNSVCTFGQGTKLEIK

SEQ ID NO: 9174 - protein, 110 aa, Artificial Sequence
  Description of Artificial Sequence: Synthetic polypeptide
DIVLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIKRT

SEQ ID NO: 9175 - protein, 112 aa, Artificial Sequence
  Description of Artificial Sequence: Synthetic polypeptide
DIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIK

SEQ ID NO: 9176 - protein, 102 aa, Artificial Sequence
  Description of Artificial Sequence: Synthetic polypeptide
QSALTQPAFVSGSPGQSITLSCSLGTADVSWYQQRPNSAPRLIIFDVKKRPSDVSDRFSGHNSDTAAFVTISELRPEDEAEYFCTSWPYRFGPGTKVDVARQ

SEQ ID NO: 9177 - protein, 100 aa, Artificial Sequence
  Description of Artificial Sequence: Synthetic polypeptide
QSALTQPAFVSGSPGQSITLSCTLGTEDVSWYQQRPNSAPRLIIFDVKKRPSDVSDRFSGHNSDTAAFLTISELRPEDEAEYFCTSWPYRFGRGTKVDVA

SEQ ID NO: 9178 - protein, 100 aa, Artificial Sequence
  Description of Artificial Sequence: Synthetic polypeptide
QSALTQPAFVSGSPGQSITLSCTLGTEDVSWYQQRPNSAPRLIIFDVKKRPSDVSDRFSGHNSDTAAFLTISELRPEDEADYFCTSWPYRFDRGTKVDVA

SEQ ID NO: 9179 - protein, 107 aa, Artificial Sequence
  Description of Artificial Sequence: Synthetic polypeptide
DIQMTQSPSSLSASIGDRVTITCRASQDIANYLNWYQKKSGTPPKLLIFGATNLHHGVSPRFSGSGHGTHFSLTITNVQHEDFANYFCQQSFQTVGSFGQGTWVDIR

SEQ ID NO: 9180 - protein, 107 aa, Artificial Sequence
  Description of Artificial Sequence: Synthetic polypeptide
DIQMTQSPSSLSASVGDRVTITCRASQDIANYLNWYQKKSGTPPKLLIFAATNLHRGVSPRFSGSGSGTHFSLTITNVQYEDFANYFCQHSFGTIGTFGQGTWVDIR

SEQ ID NO: 9181 - protein, 107 aa, Artificial Sequence
  Description of Artificial Sequence: Synthetic polypeptide
DIQMTQSPSSLSASIGDRVTITCRASQDIANYLNWYQKKSGTPPKLLIFAATNLHRGVSPRFTGSGHGTHFSLTITNVQHEDFGHYFCQQSFATVGSFGQGTWVDIR

SEQ ID NO: 9182 - protein, 107 aa, Artificial Sequence
  Description of Artificial Sequence: Synthetic polypeptide
DIQMTQSPSSLSASIGDRVTITCRASQDIANYLNWYQKKSGTPPKLLIFAATNLHRGVSPRFTGSGHGTHFSLTITNVQHEDFGNYFCQQSFATVGSFGQGTWVDIR

SEQ ID NO: 9183 - protein, 102 aa, Artificial Sequence
  Description of Artificial Sequence: Synthetic polypeptide
QSALTQPASVSGSPGQSINISCAGRSDRVSWYQQRPNGVPKLLMFDVYRRPSGVSDRFSGSHSGDTAFLTISGLQTEDEADYYCTSHPYAFGAGTKVNVLRQ

SEQ ID NO: 9184 - protein, 100 aa, Artificial Sequence
  Description of Artificial Sequence: Synthetic polypeptide
QSVLTQPAFVSGSPGQSITLSCTLGTEDVSWYQQRPNSAPRLIIFDVKKRPSDVSDRFSGHNSDTAAFLTISELRPEDEAEYFCTSWPYRFGRGTKVDVA

SEQ ID NO: 9185 - protein, 100 aa, Artificial Sequence
  Description of Artificial Sequence: Synthetic polypeptide
QSVLTQPASVSGSPGQSINISCAGRSDRVSWYQQRPNGVPKLLLFDVYRRPSGVSDRFSGSHSDDTAFLTISGLQTDDEADYYCTSHPYAFGPGTKVNVL

SEQ ID NO: 9186 - protein, 100 aa, Artificial Sequence
  Description of Artificial Sequence: Synthetic polypeptide
QSVLTQPAFVSASPGQSITLSCNLGTDYVSWYQQRPSSAPRLIIFDVKNRPSGVSDRFSGYNSDTAAFLTISGLQPEDEAEYYCTSWPYNFGPGTKVDVT

SEQ ID NO: 9187 - protein, 102 aa, Artificial Sequence
  Description of Artificial Sequence: Synthetic polypeptide
QSVLTQPASVSGSPGQTISISCSGTFGSDSVSWYQQYPNSAPTLIIFDVHRRPSGISTRFSGSTSGDTASLTISTLHREDEAYYYCTSHPYDFGGGTYVIVL

SEQ ID NO: 9188 - protein, 102 aa, Artificial Sequence
  Description of Artificial Sequence: Synthetic polypeptide
QSVLTQPASVSGSPGQTISISCSGTFGSDSVSWYQQFPNSAPTLIIFDVHRRPSGISTRFSGSTSGDTASLTISTLHREDEAFYYCTSHPYDFGGGTYVIVL

SEQ ID NO: 9189 - protein, 100 aa, Artificial Sequence
  Description of Artificial Sequence: Synthetic polypeptide
QSVLTQPAFVSGSPGQSITISCTVGTTDVSWYQQRPNSAPRLIIFDVKKRPSGVSDRFSGSSSDNAAFLTIAGLRPEDEAEYYCTSWPYRFGRGTKVDVG

SEQ ID NO: 9190 - protein, 100 aa, Artificial Sequence
  Description of Artificial Sequence: Synthetic polypeptide
QSALTHPAFVSGSPGQSITLSCTLGTEDVSWYQQRPNSAPRLIIFDVRKRPSEVSDRFSGHKSDTAAFLTISDLRPEDEAEYFCTSWPYRFDRGTRLDVA

SEQ ID NO: 9191 - protein, 102 aa, Artificial Sequence
  Description of Artificial Sequence: Synthetic polypeptide
QSALTQPASVSGSPGQSITISCTADSDYVSWYQQRPNSAPKLILFDVNSRPSGVSDRYSGSRSGNTASLTISGLQREDEADYFCTPWPYDFRPGTRVFVLGQ

SEQ ID NO: 9192 - protein, 107 aa, Artificial Sequence
  Description of Artificial Sequence: Synthetic polypeptide
ALQLTQSPSSLSASVGDRITITCRASQGVTSALAWYRQKPGSPPQLLIYDASSLESGVPSRFSGSGSGTEFTLTISTLRPEDFATYYCQQLHFYPHTFGGGTRVDVR

SEQ ID NO: 9193 - protein, 215 aa, Artificial Sequence
  Description of Artificial Sequence: Synthetic polypeptide
EIVLTQSPDTLSLSPGERATLSCRASQSVHSRYFAWYQHKPGQPPRLLIYGGSTRATGIPNRFSAGGSGTQFTLTVNRLEAEDFAVYYCQQYGRSPYTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9194 - protein, 217 aa, Artificial Sequence
  Description of Artificial Sequence: Synthetic polypeptide
QSALTQPASVSGSPGQSITISCTGTSSDVGSYNFVSWYQQHPGKAPKLMIYEVSERPSGISNRFSGSKSGNTASLTISGLQAEDEADYYCSSYAGSTTFRVFGGGTKLTVRGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9195 - protein, 210 aa, Artificial Sequence
  Description of Artificial Sequence: Synthetic polypeptide
EIVLTQSPATLSLSPGETAIISCRTSQSGSLAWYQQRPGQAPRLVIYSGSTRAAGIPDRFSGSRWGADYNLSISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9196 - protein, 211 aa, Artificial Sequence
  Description of Artificial Sequence: Synthetic polypeptide
  MOD_RES (1)..(1): Any amino acid
XSALTQPPSASGSPGQSITISCTGTSNNFVSWYQQYPGKAPKLVIYEVNKRPSGVPDRFSGSKSGSTASLTVSGLQADDEGVYYCSSLVGNWDVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9197 - protein, 265 aa, Artificial Sequence
  Description of Artificial Sequence: Synthetic polypeptide
METDTLLLWVLLLWVPGSTGDDIQMTQSPASLAVPLLLWISGAYGDIVLAQSPDSLAVSPGERATIHCKSSQTLLYSSNNRHSIAWYQQRPGQPPKLLLYWASMRLSGVPDRFSGSGSGTDFTLTINNLQAEDVAIYYCHQYSSHPPTFGHGTRVELRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9198 - protein, 221 aa, Artificial Sequence
  Description of Artificial Sequence: Synthetic polypeptide
TGVLSQSVLTQPASVSGSPGQSITISCTGTSSDVGGYKYVSWYQQHPDKAPKLMIYEVSNRPSGVSNRFSGSKSGNTASLTISGLQAEDEADYYCSSYTSSSTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9199 - protein, 211 aa, Artificial Sequence
  Description of Artificial Sequence: Synthetic polypeptide
QSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 9200 - protein, 241 aa, Artificial Sequence
  Description of Artificial Sequence: Synthetic polypeptide
QVQLVQSGAEVKKPGSSVKVSCKASGGTFSSYAISWVRQAPGQGLEWMGGIIPLFDTSNYAQNFQGRITITADKSTSTAYMELSSLRFEDTAIYYCARDNPLLLAMDVWGKGTTVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIK

SEQ ID NO: 9201 - protein, 254 aa, Artificial Sequence
  Description of Artificial Sequence: Synthetic polypeptide
VLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIKRTGGGGSGGGGSGGGGSVQLLEQSGAEVKKPGSSVQVSCKASGGTFSMYGFNWVRQAPGHGLEWMGGIIPIFGTTNYAQKFRGRVTFTADQATSTAYMELTNLRSDDTAVYYCARDFGPDWEGGDSYDGSGRGFFDFWGQGTLVNVSS

SEQ ID NO: 9202 - protein, 254 aa, Artificial Sequence
  Description of Artificial Sequence: Synthetic polypeptide
VLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIKRTGGGGSSGGASGGGGSVRLLEQSGAEVKKPGSSVQVSCKASGGTFSMYGVNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSS

SEQ ID NO: 9203 - protein, 254 aa, Artificial Sequence
  Description of Artificial Sequence: Synthetic polypeptide
VLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIKRTGGGGSGGGGSGGGGSVQLLEQSGAEVKKPGSSVQVSCKASGGTFSMYGFNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSS

SEQ ID NO: 9204 - protein, 256 aa, Artificial Sequence
  Description of Artificial Sequence: Synthetic polypeptide
HHHHHHQVQLVQSGAEVKKPGASVKVSCQASGYRFSHFTVHWVRQAPGQRFEWMGWINPYNGNKEFSAKFQDRVTFTADTSANTAYMELRSLRSADTAVYYCARVGEWGWDDSPYDNYYMDVWGKGTTVIVSSGGGGSGGGGSGGGGSEIVLTQAPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERK

SEQ ID NO: 9205 - protein, 240 aa, Artificial Sequence
  Description of Artificial Sequence: Synthetic polypeptide
QVQLVQSGAEVRKPGASVKVSCKASGDTFSSYAISWVRQAPGQGLEWMGGIIPIFGTANYAQKFQGRVTITADESTSTAYMELSSLRSEDTAIYYCARDNPTLLGSDYWGKGTLVTVSSGGGGSGGGGSGGGGSDIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEI

SEQ ID NO: 9206 - protein, 487 aa, Artificial Sequence
  Description of Artificial Sequence: Synthetic polypeptide
VLTQSPGTLSLSAGERATLSCRASQSVSSGSLAWYQQKPGQAPRLLIYGASTRATGIPDRFSGSGSGTDFTLTIGRLEPEDLAVYYCQQYGTSPYTFGQGTKLEIKRTGGGGSSGGASGGGGSVRLLEQSGAEVKKPGSSVQVSCKASGGTFSMYGVNWVRQAPGHGLEWMGGIIPIFGTSNYAQKFRGRVTFTADQATSTAYMELTNLRSDDTAVYYCARDFGPDWEDGDSYDGSGRGFFDFWGQGTLVTVSSGGGGSGGGGSGGGGSGGGGSGGGGSGGGGSMNRGVPFRHLLLVLQLALLPAATQGKKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLA

SEQ ID NO: 9207 - protein, 231 aa, Artificial Sequence
  Description of Artificial Sequence: Synthetic polypeptide
EVQLVESGGGLVKPGGSLRLTCVASGFTFSDVWLNWVRQAPGKGLEWVGRIKSRTDGGTTDYAASVKGRFTISRDDSKNTLYLQMNSLKTEDTAVYSCTTDGFIMIRGVSEDYYYYYMDVWGKGTTVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVEL

SEQ ID NO: 9208 - protein, 216 aa, Artificial Sequence
  Description of Artificial Sequence: Synthetic polypeptide
QSVLTQPPSVSAAPGQKVTISCSGSSSNIGNNYVLWYQQFPGTAPKLLIYGNNKRPSGIPDRFSGSKSGTSATLGITGLQTGDEADYFCATWDSGLSADWVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 9209 - protein, 224 aa, Artificial Sequence
  Description of Artificial Sequence: Synthetic polypeptide
QVQLQESGPGLVKPSETLSLTCTVSGGSISSHYWSWIRQSPGKGLQWIGYIYYSGSTNYSPSLKSRVTISVETAKNQFSLKLTSMTAADTAVYYCARGPVPAVFYGDYRLDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 9210 - protein, 215 aa, Artificial Sequence
  Description of Artificial Sequence: Synthetic polypeptide
EIVLTQSPGTLSLSAGERATLSCRASQSVSSRYLAWYQQKPGQAPRLLIYGASSRATGIPDRFSGSGSGTDFTLTISRVEPEDFAVYYCQQYDNSVCTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 9211 - protein, 245 aa, Artificial Sequence; identical to SEQ ID NO: 7739
  Description of Artificial Sequence: Synthetic polypeptide

SEQ ID NO: 9212 - protein, 213 aa, Artificial Sequence; identical to SEQ ID NO: 8777
  Description of Artificial Sequence: Synthetic polypeptide

SEQ ID NO: 9213 - protein, 245 aa, Artificial Sequence
  Description of Artificial Sequence: Synthetic polypeptide
QVQLVQSGAEVKKPGSSVKVSCKASGGTFNSYAFSWVRQAPGQGLEWMGSIIPIFGTTNYAQKFQGRVTITADESTSTAYMELSSLRSEDTAVYYCARYFDTYNNYGFANWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSEFEQKLISEEDLNGAPHHHHHH

SEQ ID NO: 9214 - protein, 213 aa, Artificial Sequence; identical to SEQ ID NO: 8777
  Description of Artificial Sequence: Synthetic polypeptide

SEQ ID NO: 9215 - protein, 200 aa, Artificial Sequence
  Description of Artificial Sequence: Synthetic polypeptide
ALQLTQSPSSLSASVGDRITITCRASQGVTSALAWYRQKPGSPPQLLIYDASSLESGVPSRFSGSGSGTEFTLTISTLRPEDFATYYCQQLHFYPHTFGGGTRVDVRRTVAAPSVFIFPPSDEQLKSGTASVVCLLNNFYPREAKVQWKVDNALQSGNSQESVTEQDSKDSTYSLSSTLTLSKADYEKHKVYACEVTHQG

SEQ ID NO: 9216 - protein, 462 aa, Artificial Sequence
  Description of Artificial Sequence: Synthetic polypeptide
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLFGVPIARGPVNAMDVWGQGITVTISSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKAFPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 9217 - protein, 228 aa, Artificial Sequence
  Description of Artificial Sequence: Synthetic polypeptide
VQLLESGPGVVKPSETLSLTCTVSGASVNNYYWTWVRQPPGKGLEWIGNVYDSGDTNYNPSLSSRLSLSMDTSKNQFSLRLSSVTAADTATYYCARYHRHFIRGPLSFDYWGRGTLVTVSSASTKGPSVFPLAPSSKSTSGGTSALGCLVKDYFPEPVTVSWNSGALTSGVHTFPAVLQSSGLYSLSSVVTVPSSSLGTQTYICNVNHKPSNTKVDKKVEPKSCDKTS

SEQ ID NO: 9218 - protein, 213 aa, Artificial Sequence
  Description of Artificial Sequence: Synthetic polypeptide
LQMTQSPSFLSASVGDRVSITCRASQDIQKFLAWYQLTPGDAPKLLMYSASTLQSGVPSRFSGSGSGTEFTLTISGLQPEDFATYYCQHLKRYPYTFGQGTKLEISRTVAAPSVFIFPPSDEQLKSGTASVVCLLNNFYPREAKVQWKVDNALQSGNSQESVTEQDNKDSTYSLSSTLTLSKADYEKHKVYACEVTHQGLSSPVTKSFNRGEC

SEQ ID NO: 9219 - protein, 238 aa, Artificial Sequence
  Description of Artificial Sequence: Synthetic polypeptide
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 9220 - protein, 216 aa, Artificial Sequence; identical to SEQ ID NO: 8768
  Description of Artificial Sequence: Synthetic polypeptide

SEQ ID NO: 9221 - protein, 25 aa, Artificial Sequence
  Description of Artificial Sequence: Synthetic peptide
GGGGSGGGGSGGGGSGGGGSGGGGS

SEQ ID NO: 9222 - protein, 50 aa, Artificial Sequence
  Description of Artificial Sequence: Synthetic Polypeptide
  MISC_FEATURE (1)..(50): This sequence may encompass 1-10 "Gly Gly Gly Gly Ser" repeating units
GGGGSGGGGSGGGGSGGGGSGGGGSGGGGSGGGGSGGGGSGGGGSGGGGS

SEQ ID NO: 9223 - protein, 4 aa, Artificial Sequence
  Description of Artificial Sequence: Synthetic peptide
KDEL
